United States Patent 12,397,048 (BUNYAVIRALES VACCINE) - sequence listing, part 7

SEQ ID NO: 9230 - RNA, 4305 nt, synthetic construct
  misc_feature 1..4305: note = derived and/or modified CDS sequence (opt4) from ANADV(EIV-18560Yak)__KT313754.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcatctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacgaggaggccaagaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaacagagacttcgccggcgagatgaacaccacctaccacagcaagagagacttcttcaagcacgacttcaacctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctgatcgtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacaacagactgatcatcagccccaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga

SEQ ID NO: 9231 - RNA, 4305 nt, synthetic construct
  misc_feature 1..4305: note = derived and/or modified CDS sequence (opt4) from ANADV(EIV-18715Yak)__KT313757.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagaagggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctgatctgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccaagaagctggtgggcaccagcagagtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcagcctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatctacaagacccccaccagaatctacaagagcaacaacaagggcgagatctggtgcgccggcgacgtgcactgcttccaggagttcacccccgtgctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcgtgtgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacagcagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatggtgttcaagctgaaggacatcctgaagaagaacgagctgctgtacctgcaggagatgaagtacaagtga

SEQ ID NO: 9232 - RNA, 4305 nt, synthetic construct
  misc_feature 1..4305: note = derived and/or modified CDS sequence (opt4) from ANADV(EIV-23263Tyum)__KT313760.1__GP
  source 1..4305: mol_type = other RNA
atgttcctgatcctggtgctgctgatccccttctacatcaccgccacccccgtgaccaccagatgcttccacggcggccagctgatcgccgagagcaagagcctgaccgccatcagcgagttctgcctgaaggacgacgtgagcaccgtgaagagcgagatcacctacctgaagaacgacaccggcatcttcgcccacagcaaggtgctgagaaactggatcatcaaggactggaagaactgcaaccccgtgcccaccgccggcggcagcatcaacgtgatcgaggtgaacgccgacctgagcctgagcaccaagacctacgtgtgcagcagagactgcaccatcaccgtggacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcaccatggccgtgagcatctgccagaacatcgagctgatcatcatcaccagcctgaccctgatcatcttcatcctgatggtgatcctgaccaagacctacatctgctacgtgctgatgcccctgttcatgcccgtggcctacctgtacggctgggcctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcgtgctgatcctgagcttcgtgacccccatcgagggcaccctgaccaactaccccgagagcaagaagtacagcctggaggagatcgccgacgtgatcgagggcttcatcgccgagagaggcatcaaggagtacatcgtgctgtacaccagcatcttcggcgccctgctgctgctgatcgccctgatcatcaccgtgagcctgaacagaatcaccgagtacctgaccaacctgaacgtgatctactgccacgagtgcagcatgtaccacagcaagaagaacatcaagtacatcggcgacttcaccaacaagtgcggcttctgcacctgcggcgagctggaggaccaggagggcctgaacatgcacaaggtgagcaagaagtgcatctacagataccagctgacctggagcaaggtgatcatgaccatcctggtgtgcctgctgatcgcccagaacaccgtgctgatcgtggccgccaacgacgactgctgggccaagcagagcctggagatcgagtgcgtgggccccctgcagcaggtggacgcctgcgaggacaagagcagcagaagctacaacggcgaggccagaaagctggtgggcaccagcaaggtgaccgagctggacgccggccaggtgaacctgctgggccagaccatcgagagcgccatcatcgccatcagaaagcagagaacctacgccaccatgcacttcctggagagcgtgttcctgggcagacactgcgactactacaaggtgttcgagcacaacagcggctacagccaggccaagtggagactgctggccaagaccaaccacttcgacatctgcagcagacacagcacccaccacttctgcagatgcatgagcgacggcaccaagtgcgagaacggcaactgggacttcgccggcgagatgaacaccacctaccacagcaagagagacttcttcaagcacgacttcaagctgttctgcaccctgctggagaacgccttccccggcaccaccgagagcctgtactaccagctgctgagcaagagaaacaccaccggcgccagcaagctgctgggcaagctgatcaccaagttcggcaacaacaacctgttcgtgggcatctggaagttcggccagttcctgctgagcctgccctacgtgaacaacaccgagctgagcgccctgcagagcagcaagatcctggagagccccgagcccctgctgagaagcgccagcggcagacaggagagcctgagcagcgccacccccggcgaggccagcaaggagtgcagaaacgccaagaagatcagctgcatcagccccagattcggcgtgcccatggagaacctgaccgcctgcggcgagagccccaactacaagatcttcaagacccccaccagaatctacaagagcaacaacaagggcgagatctggtgcgccggcgacgtgcactgcttccaggagttcacccccatcctgcaggaggtggtggacaagctgaagaagatgacctgcttcctgaccgagcccgaggccgaggaggacgccttcagcatcgccatcgccatgtgcaagatcctggacaagggcgtgtgcaccatcaacagcgagagatggaacatcatcaagtgcgacagcggcctgatgtactacaccgaccagagagacggccaggacaccggcaacgacttcggcgagtactgcatcagccacaactgcaagaccgagagattccccatcaaccccagcatcatcagcgactgcatctgggagtaccacagcagaaagagcagatacatcagcaccctgaacctggagagcctggaggagttcaagagagccatcagcgagaagctgagccacaccctggtggtgtaccagttcaagcccaccagcaacctgccccacatgaagcccgtgtacaagtacatcaccgcccagggcgtggagaacagcgacggcatcgacagcgccttcatcaccgccagcatgcccgccctgagcggcaccagcatcggctacaacgtgatgagcaaggacaacttccccctgttcgacatcatcatcttcatcaagagcgccgtgatcaagaccacctacaaccacatctacgacaccggccccaccatcggcatcaacgtgatgcacgacgagcactgcaccggccagtgccccatcgagatcccccacaaggagaactggctgaccttcagccaggagagaaccagcagatggggctgcgaggagttcggctgcctggccatcaacaccggctgcgtgttcggcagctgccaggacatcatcagacccgagaccaaggtgtacagaaaggccatcgaggagagcgtgctgctgaccgtgtgcgtgacctaccccggcaacaccttctgcaccgagatcaacgccatcgagcccaagatcaccgacgagctggagctgcagttcaagaccgtggacaccaagaccctgcccaacctgctggccgtgcagaaccacaagctgtacagcggccagatcaacgacctgggcagcttcgcccagggctgcggcaacatccagaagaccaacctgagcgtgatcggcaccggcaccgccaagttcgactacatctgccacggcgccagcagaaaggacatcgtggtgagaagatgctacaacaacaactacgagagctgcaagctgctgaaggaggagcccagcctgatcttcagcgacaaccacgagaccatcgaggtggccaacatcagacacctgctgggcgagctgcagttcaagctgatgctgggcgacctgagatacaagagcttcgccgagaaccccgagctggagatcgaggccagatgcgtgggctgccccagctgcttcagcagctacagctgcaacttcagaatcagcagcagcatcgacaccgtgtgcgccatcgacggcccctgcaccatcttccacaacagactgatcatcagcagcaccaagcaggactacggcatcaagatgagctgcaaggagaagcccaaccccgtggagaagttcaacatctgcaagagagtgtacagcgtgctgttcaccaccatcgacaagaacgacaagatcgagatcaacaccggcgaccagaccagcttcatccaggagaaggacgacagatgcaagacctggctgtgcagagtgagagacgagggcatcagcgtgatcttcgagcccatcaaggccttcttcggcagctacttcagcatcgccttctacgtggtgatcggcatcatcgccctgttcatcatcatctacatcttcctgcccatgggcttcaagctgaaggacatcctgaagaagaacgagctgctgtacctgcaggagatgaagtacaagtga

SEQ ID NO: 9233 - RNA, 4305 nt, synthetic construct
  misc_feature 1..4305: note = derived and/or modified CDS sequence (opt4) from BATV(804992)__FJ436801.1__GP
  source 1..4305: mol_type = other RNA
atgctgctgctgctggtgctgctgatcccctgctgcgtgagcgccagccccgtgatcaccagatgcttccacggcggccagctgatcgccgagagaaagagccaggccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaaggtgatcatgatgatcctggtgtgcctgctgatcgcccagaacaccatcctgatcgtggccgccagcgacgactgctggaccaagaagagcctggagatggagtgcatcggccccctgcagcaggtggacacctgcgacgacaagaccagcagaagctacagcggcgaggccaagaagctggtgagagccagcaagatcagcgacctggacgccgcccaggtgggcctgctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcatctaccagagcaagaaggacttcttcaagcacgacttcaagctgttctgcaccctggtggagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccatccagctggccaaggtgctggaggtgaccgaccagcaccacagaagcgtgagcggcagacaggagagcctggccagcgccacccccggcagcaagagcagcgagtgcgaccacgccaagaaggtgagctgcatcagccccagattcggcgcccccatggagggcctgatggcctgcggcaacagccccaactacaagatctacaagacccccgccaagctgtacaagagcaacaacaagggcgaggtgtggtgcagcggcgacgtgcactgcttccaggagctgacccccgccagccaggagagcgtggacagaatcaagcagatgacctgcttcctgaccgagcccgaggtgaacgacgacgtgttcagcatcgccatcgccatgtgcaaggtgcaggacaagggcgtgtgcaccatcaacgaggacagatggaacatcatcaagtgcgacagcggcctgatctactacaccgaccagagagagggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagagcctggaggagttcaagagagccatcagcgagaagctgagccacaccctggtggtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccggcctgaccgaggagttccagatctgcaagaagacctacaccgtgctgttcgccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatgttcaagctgagagacgtgctgaagagaaacgagtacctgtacctgcaggagatcaagcacaagtga

SEQ ID NO: 9234 - RNA, 4305 nt, synthetic construct
  misc_feature 1..4305: note = derived and/or modified CDS sequence (opt4) from BATV(8627-11)__FJ436799.1__GP
  source 1..4305: mol_type = other RNA
atgctgctgctgctggtgctgctgatcccctgctgcgtgagcgccagccccgtgatcaccagatgcttccacggcggccagctgatcgccgagagaaagagccaggccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaaggtgatcatgatgatcctggtgtgcctgctgatcgcccagaacaccatcctgatcgtggccgccagcgacgactgctggaccaagagaagcctggagatggagtgcatcggccccctgcagcaggtggacacctgcgacgacaagaccagcagaagctacagcggcgaggccaagaagctggtgagagccagcaagatcagcgacctggacgccgcccaggtgggcctgctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctggtggagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccagcaccacagaagcgtgagcggcagacaggagagcctggccagcgccacccccggcagcaagagcagcgagtgcgaccacgccaagaaggtgagctgcatcagccccagattcggcgtgcccatggagggcctgatggcctgcggcaacagccccaactacaagatctacaagacccccgccaagctgtacaagagcaacaacaagggcgaggtgtggtgcagcggcaacgtgcactgcttccaggagctgaaccccgccagccaggagagcgtggacagaatcaagcagatgacctgcttcctgaccgagcccgaggtgaacgacgacgtgttcagcatcgccatcgccatgtgcaaggtgcaggacaagggcgtgtgcaccatcaacaaggacagatggaacatcatcaagtgcgacagcggcctgatctactacaccgaccagagagagggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagagcctggaggagttcaagagagccatcagcgagaagctgagccacaccctggtggtgtacaacttcaagcccaccgccaacctgccccacatcaagcccgtgtacgagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccagacaggactacggcatcaagatgagctgcaagaccaagcccggcctgaccgaggagttccagatctgcaagaagacctacaccgtgctgttcgccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatgttcaagctgagagacgtgctgaagagaaacgagtacctgtacctgcaggagatcaagcacaagtga

SEQ ID NO: 9235 - RNA, 4305 nt, synthetic construct
  misc_feature 1..4305: note = derived and/or modified CDS sequence (opt4) from BATV(Chittoor/IG-20217)__JX846599.1__GP
  source 1..4305: mol_type = other RNA
atgctgctgctgctggtgctgctgatcccctgctgcgtgagcgccagccccgtgatcaccagatgcttccacggcggccagctgatcgccgagagaaagagccaggccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatgatcatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaaggtgatcatgatgatcctggtgtgcctgctgatcgcccagaacaccatcctgatcgtggccgccagcgacgactgctggaccaagaagagcctggagatggagtgcatcggccccctgcagcaggtggacacctgcgacgacaagaccagcagaagctacagcggcgaggccaagaagctggtgagagccagcaagatcagcgacctggacgccgcccaggtgggcctgctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagagagacttcttcgagcacgacttcaagctgttctgcaccctgatcgagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatcagcctgccctacgtgaacgagaccagcctgagccccacccagctggccaaggtgctggaggtgaccgaccagcaccacagaagcatcagcggcagacaggagagcctggccagcgccacccccggcagcaagagcagcgagtgcgaccacgccaagaaggccagctgcatcagccccagattcggcgtgcccatggagggcctgatggcctgcggcaacagccccaactacaagatctacaagacccccgccaagctgtacaagagcaacaacaagggcgaggtgtggtgcagcggcaacttccactgcttccaggagctgatccccgccagccaggagagcgtggacagaatcaagcagatgacctgcttcctgaccgagcccgaggtgaacgacgacgtgttcagcatcgccatcgccatgtgcaaggtgcaggacaagggcgtgtgcaccatcaacaaggacagatggaacgtgatcaagtgcgacagcggcctgatctactacaccgaccagagagagggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacatcaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccggcctgaccgaggagttccagatctgcaagaagacctacaccgtgctgttcgccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatgttcaagctgagagacgtgctgaagagaaacgagtacctgtacctgcaggagatcaagcacaagtga

SEQ ID NO: 9236 - RNA, 4305 nt, synthetic construct
  misc_feature 1..4305: note = derived and/or modified CDS sequence (opt4) from BATV(41.3)__KM507322.1__GP
  source 1..4305: mol_type = other RNA
atgctgctgttcctgatcctgctgatcccctgctacgccagcgccagccccgtggtgaccagatgcttccacggcggccagctgatcgccgagagcagaagccccaccgccgtgagcgagttctgcctgaaggacgacgtgagcaccatcaagagcgagatcatctacgtgaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacagcaccatcctgcccggcaccatggccaccagcatctgccagaacatcgagctgatcatcatcatcagcctgaccctgctgatcttcatcctgatggccatcctgaccaagacctacatctgctacctgctgatgcccctgttcatgcccatcgcctacctgtacggctggagctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcaccgagaagggcatcaaggagtacgtggtgttctacaccagcatcttcggcggcctgttcctgctgctggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcaacgactgctgggccaagaagagcctggagatggagtgcatcggccccctgcagcaggtggagagctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctggccaagcactgcgactactacaagagcttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctgctggagaacgccttccccggcaccaccgagagcttctactaccagatgctgcagaagaagaacaccaccggcgtggtgaagctgctggacgagctgaccaagaagttcggcaacaacaacatgttcgtgggcatctggaagttcggccagtacctgatgagcctgccctacatcaacgagaccagcctgacccccctgcagctgagcaagatcctggaggccagcaaccagcaccacagaagcatcagcggcagacaggagagcctggccaacgccgccagcggcggcaagagcaaggagtgcgaccacgccaagaaggtgagctgcatcagccccagattcggcgtgcccatggagggcctgatcgcctgcggcagcagccccaactacaagatctacaagatgcccaccaagctgtacaagagcaacaacaagggcgaggtgtggtgcagcggcgacgtgcactgcttccaggagctgaaccccgccagccaggagagcgtggacagaatcaagcagatgacctgcttcctgaccgagcccgagaccaacgaggacgtgttcagcatcgccatcagcatgtgcaaggtgcaggacaagggcgtgtgcaccatcaacgaggagagatggaacgtgatcaagtgcgacagcggcctgatctactacaccgaccagagagacggccaggacaccggcaacgacttcggcgagtactgcctgagccacaactgcagaatcgagagattccccatcaaccccaccatcatcaacgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcaaggacaacttccccctgttcgacatcatcatcttcatcaagagcgccgtgatcaaggccacctacaaccacatctacgacaccggccccaccatcggcatcaacgtgatgcacgacgagcactgcaccggccagtgccccaccgacatcccccacaaggagaactggatcaccttcagccaggagagaaccagcagatggggctgcgaggagttcggctgcctggccgtgaacaccggctgcgtgttcggcagctgccaggacatcatcagacccgagaccaaggtgtacagaaaggccatcgaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcagactgctgaaggaggagcagagcctgatgttcgccgacaaccacgagaccatcgacgtggccaacgtgagacacctgctgggcgacctgcagttcaagctgatgctgggcgacctgagatacaagagcttcgccgaggaccccgacctggagatcgaggccaagtgcgtgggctgccccagctgcttcaccagctacagctgcaacttcagaatcgtgagcaacatcgacaccgtgtgcagcatcgagggcccctgcaccaccttccacaacagactgatgatcaccagcaccaagcaggactacggcatcaagatgagctgcaagggcaagcccggcagcaccgaggagttccagatctgcaagaagacctacaccgtgctgttcaccaccgtggagaagaacgacaagatcgagatcaacaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtggtgggcatcatcgtgctgttcctgatgatctacatcttcctgcccatggccttcaagctgagagacgtgctgaagagaaacgagtacctgtacctgcaggagatcaagcacaagtga

SEQ ID NO: 9237 - RNA, 4305 nt, synthetic construct
  misc_feature 1..4305: note = derived and/or modified CDS sequence (opt4) from BATV(EIV-1217Astr)__KT313699.1__GP
  source 1..4305: mol_type = other RNA
atgctgctgttcctgatcctgctgatcccctgctacgccagcgccagccccgtggtgaccagatgcttccacggcggccagctgatcgccgagagcagaagccccaccgccgtgagcgagttctgcctgaaggacgacgtgagcaccatcaagagcgagatcatctacgtgaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgctgatcttcatcctgatggccatcctgaccaagacctacatctgctacctgctgatgcccctgttcatgcccatcgcctacctgtacggctggagctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtgaccgagaagggcatcaaggagtacgtggtgttctacaccagcatcttcggcggcctgttcctgctgctggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcaacgactgctgggccaagaagagcctggagatggagtgcatcggccccctgcagcagatggagagctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctggccaagcactgcgactactacaagagcttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcaagcacgacttcaagctgttctgcaccctgctggagaacgccttccccggcaccaccgagagcttctactaccagatgctgcagaagaagaacaccaccggcgtggtgaagctgctggacgagctgaccaagaagttcggcaacaacaacatgttcgtgggcatctggaagttcggccagtacctgatgagcctgccctacatcaacgagaccagcctgacccccctgcagctgagcaagatcctggaggccagcgaccagcaccacagaagcatcagcggcagacaggagagcctggccaacgccgccagcggcggcaagagcaaggagtgcgaccacgccaagaaggtgagctgcatcagccccagattcggcgtgcccatggagggcctgatcgcctgcggcggcagccccaactacaagatctacaagatgcccaccaagctgtacaagagcaacaacaagggcgaggtgtggtgcagcggcgacgtgcactgcttccaggagctgaaccccgccctgcaggagagcgtggacagaatcaagcagatgacctgcttcctgaccgagcccgagaccaacgaggacgtgttcagcatcgccatcagcatgtgcaaggtgcaggacaagggcgtgtgcaccatcaacgaggagagatggaacgtgatcaagtgcgacagcggcctgatctactacaccgaccagagagacggccaggacaccggcaacgacttcggcgagtactgcctgagccacaactgcagaatcgagagattccccatcaaccccaccatcatcaacgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcaaggacaacttccccctgttcgacatcatcatcttcatcaagagcgccgtgatcaaggccacctacaaccacatctacgacaccggccccaccatcggcatcaacgtgatgcacgacgagcactgcaccggccagtgccccaccgacatcccccacaaggagaactggatcaccttcagccaggagagaaccagcagatggggctgcgaggagttcggctgcctggccgtgaacaccggctgcgtgttcggcagctgccaggacatcatcagacccgagaccaaggtgtacagaaaggccatcgaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcagactgctgaaggaggagcagagcctgatgttcgccgacaaccacgagaccatcgacgtggccaacgtgagacacctgctgggcgacctgcagttcaagctgatgctgggcgacctgagatacaagagcttcgccgaggaccccgacctggagatcgaggccaagtgcgtgggctgccccagctgcttcaccagctacagctgcaacttcagaatcgtgagcaacatcgacaccgtgtgcagcatcgagggcccctgcaccaccttccacaacagactgatgatcaccagcaccaagcaggactacggcatcaagatgagctgcaagggcaagcccggcagcaccgaggagttccagatctgcaagaagacctacaccgtgctgttcaccaccgtggagaagaacgacaagatcgagatcaacaccggcgaccagaccagcttcatccaggagagagacgacagatgcaagacctggctgtgcagagtgagagacgagggcatcagcgtggtgttcgagcccatcagagccttcttcggcagctacttcagcatcgccttctacatcgtggtgggcatcatcgtgctgttcctggtgatctacatcttcctgcccatggccttcaagctgagagacgtgctgaagagaaacgagtacctgtacctgcaggagatcaagcacaagtga

SEQ ID NO: 9238 - RNA, 4305 nt, synthetic construct
  misc_feature 1..4305: note = derived and/or modified CDS sequence (opt4) from BATV(EIV-12497Bl)__KT313692.1__GP
  source 1..4305: mol_type = other RNA
atgctgctgttcctgatcctgctgatcccctgctacgccagcgccagccccgtggtgaccagatgcttccacggcggccagctgatcgccgagagcagaagccccaccgccgtgagcgagttctgcctgaaggacgacgtgagcaccatcaagagcgagatcatctacgtgaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcaccagcctgaccctgctgatcttcatcctgatggccatcctgaccaagacctacatctgctacctgctgatgcccctgttcatgcccatcgcctacctgtacggctggagctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcaccgagaagggcatcaaggagtacgtggtgttctacaccagcatcttcggcggcctgttcctgctgctggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcaacgactgctgggccaagaagagcctggagatggagtgcatcggccccctgcagcaggtggagagctgcgacgacaaggccagcagaagctacagcggcgaggccaagaagctggtgagagccagcaagatcagcgacctggacgccgcccaggccggcctgctgggcagcaccatcgagagcgccatcgccagcatcagaaagcagagaacctaccccaccatgcacctgctggagagcgtgttcctggccaagcactgcgactactacaagagcttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctgctggagaacgccttccccggcaccaccgagagcttctactaccagctgctgcagaagaagaacaccaccggcgtggtgaagctgctggacgagctgaccaagaagttcggcaacaacaacatgttcgtgggcatctggaagttcggccagtacctgatgagcctgccctacatcaacgagaccagcctgacccccctgcagctgagcaagatcctggaggccagcgaccagcaccacagaagcatcagcggcagacaggagagcctggccagcgccgccagcggcggcaagagcaaggagtgcgaccacgccaagaaggtgagctgcatcagccccagattcagcgtgcccatggagggcctgatcgcctgcggcagcagccccaactacaagatctacagaatgcccaccaagctgtacaagagcaacaacaagggcgaggtgtggtgcagcggcgacgtgcactgcttccaggagctgaaccccgccagccaggagagcgtggacagaatcaagcagatgatctgcttcctgaccgagcccgaggtgaacgaggacgtgttcagcatcgccatcagcatgtgcaaggtgcaggacaagggcgtgtgcaccatcaacgaggagagatggaacgtgatcaagtgcgacagcggcctgatctactacaccgaccagagagacggccaggacaccggcaacgacttcggcgagtactgcctgagccacaactgcagaatcgagagattccccatcaaccccaccatcatcaacgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccgtgatcaaggccacctacaaccacatctacgacaccggccccaccatcggcatcaacgtgatgcacgacgagcactgcaccggccagtgccccaccgacatcccccacaaggagaactggatcaccttcagccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcagactgctgaaggaggagcagagcctgatgttcgccgacaaccacgagaccatcgacgtggccaacgtgagacacctgctgggcgacctgcagttcaagctgatgctgggcgacctgagatacaagagcttcgccgaggaccccggcctggagatcgaggccaagtgcgtgggctgccccagctgcttcaccagctacagctgcaacttcagaatcgtgagcaacatcgacaccgtgtgcagcatcgagggcccctgcaccaccttccacaacagactgatgatcaccagcaccaagcaggactacggcatcaagatgagctgcaagggcaagcccggcagcaccgaggagttccagatctgcaagaagacctacaccgtgctgttcaccaccatcgagaagaacgacaagatcgagatcaacaccggcgaccagaccagcttcgtgcaggagagagacgacagatgcaagacctggctgtgcagagtgagagacgagggcatcagcgtgatcttcgagcccatcagagccttcttcggcagctacttcagcatcgccttctacatcgtggtgggcatcatcgtgctgttcctggtgatctacatcttcctgcccatggccttcaagctgagagacgtgctgaagagaaacgagtacctgtacctgcaggagatcaagcacaagtga

SEQ ID NO: 9239 - RNA, 4305 nt, synthetic construct
  misc_feature 1..4305: note = derived and/or modified CDS sequence (opt4) from BATV(EIV-12845Ms)__KT313690.1__GP
  source 1..4305: mol_type = other RNA
atgctgctgttcctgatcctgctgatcccctgctacgccagcgccagccccgtggtgaccagatgcttccacggcggccagctgatcgccgagaacagaagccccaccgccgtgagcgagttctgcctgaaggacgacgtgagcaccatcaagagcgagatcatctacgtgaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacagcaccatcctgcccggcaccatggccaccagcatctgccagaacatcgagctgatcatcatcatcagcctgaccctgctgatcttcatcctgatggccatcctgaccaagacctacatctgctacctgctgatgcccctgttcatgcccatcgcctacctgtacggctggagctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcaccgagaagggcatcaaggagtacgtggtgttctacaccagcatcttcggcggcctgttcctgctgctggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcaacgactgctgggccaagaagagcctggagatggagtgcatcggccccctgcagcaggtggagagctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctggccaagcactgcgactactacaagagcttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctgctggagaacgccttccccggcaccaccgagagcttctactaccagatgctgcagaagaagaacaccaccggcgtggtgaagctgctggacgagctgaccaagaagttcggcaacaacaacatgttcgtgggcatctggaagttcggccagtacctgatgagcctgccctacatcaacgagaccagcctgacccccctgcagctgagcaagatcctggaggccagcgaccagcaccacagaagcatcagcggcagacaggagagcctggccaacgccgccagcggcagcaagagcaaggagtgcgaccacgccaagaaggtgagctgcatcagccccagattcggcgtgcccatggagggcctgatcgcctgcggcagcagccccaactacaagatctacaagatgcccaccaagctgtacaagagcaacaacaagggcgaggtgtggtgcagcggcgacgtgcactgcttccaggagctgaaccccgccagccaggagagcgtggacagaatcaagcagatgacctgcttcctgaccgagcccgagaccaacgaggacgtgttcagcatcgccatcagcatgtgcaaggtgcaggacaagggcgtgtgcaccatcaacgaggagagatggaacgtgatcaagtgcgacagcggcctgatctactacaccgaccagagagacggccaggacaccggcaacgacttcggcgagtactgcctgagccacaactgcagaatcgagagattccccatcaaccccaccatcatcaacgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcaaggacaacttccccctgttcgacatcatcatcttcatcaagagcgccgtgatcaaggccacctacaaccacatctacgacaccggccccaccatcggcatcaacgtgatgcacgacgagcactgcaccggccagtgccccaccgacatcccccacaaggagaactggatcaccttcagccaggagagaaccagcagatggggctgcgaggagttcggctgcctggccgtgaacaccggctgcgtgttcggcagctgccaggacatcatcagacccgagaccaaggtgtacagaaaggccatcgaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaactacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcagactgctgaaggaggagcagagcctgatgttcgccgacaaccacgagaccatcgacgtggccaacgtgagacacctgctgggcgacctgcagttcaagctgatgctgggcgacctgagatacaagagcttcgccgaggaccccgacctggagatcgaggccaagtgcgtgggctgccccagctgcttcaccagctacagctgcaacttcagaatcgtgagcaacatcgacaccgtgtgcagcatcgagggcccctgcaccaccttccacaacagactgatgatcaccagcaccaagcaggactacggcatcaagatgagctgcaagggcaagcccggcagcaccgaggagttccagatctgcaagaagacctacaccgtgctgttcaccaccgtggagaagaacgacaagatcgagatcaacaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtggtgggcatcatcgtgctgttcctggtgatctacatcttcctgcccatggccttcaagctgagagacgtgctgaagagaaacgagtacctgtacctgcaggagatcaagcacaagtga

SEQ ID NO: 9240 - RNA, 4305 nt, synthetic construct
  misc_feature 1..4305: note = derived and/or modified CDS sequence (opt4) from BATV(EIV-2077Astr)__KT313702.1__GP
  source 1..4305: mol_type = other RNA
atgctgctgttcctgatcctgctgatcccctgctacgccagcgccagccccgtggtgaccagatgcttccacggcggccagctgatcgccgagagcagaagccccaccgccgtgagcgagttctgcctgaaggacgacgtgagcaccatcaagagcgagatcatctacgtgaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgctgatcttcatcctgatggccatcctgaccaagacctacatctgctacctgctgatgcccctgttcatgcccatcgcctacctgtacggctggagctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtgaccgagaagggcatcaaggagtacgtggtgttctacaccagcatcttcggcggcctgttcctgctgctggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcaacgactgctgggccaagaagagcctggagatggagtgcatcggccccctgcagcagatggagagctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctggccaagcactgcgactactacaagagcttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctgctggagaacgccttccccggcaccaccgagagcttctactaccagatgctgcagaagaagaacaccaccggcgtggtgaagctgctggacgagctgaccaagaagttcggcaacaacaacatgttcgtgggcatctggaagttcggccagtacctgatgagcctgccctacatcaacgagaccagcctgacccccctgcagctgagcaagatcctggaggccagcgaccagcaccacagaagcatcagcggcagacaggagagcctggccaacgccgccagcggcggcaagagcaaggagtgcgaccacgccaagaaggtgagctgcatcagccccagattcggcgtgcccatggagggcctgatcgcctgcggcggcagccccaactacaagatctacaagatgcccaccaagctgtacaagagcaacaacaagggcgaggtgtggtgcagcggcgacgtgcactgcttccaggagctgaaccccgccctgcaggagagcgtggacagaatcaagcagatgacctgcttcctgaccgagcccgagaccaacgaggacgtgttcagcatcgccatcagcatgtgcaaggtgcaggacaagggcgtgtgcaccatcaacgaggagagatggaacgtgatcaagtgcgacagcggcctgatctactacaccgaccagagagacggccaggacaccggcaacgacttcggcgagtactgcctgagccacaactgcagaatcgagagattccccatcaaccccaccatcatcaacgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcaaggacaacttccccctgttcgacatcatcatcttcatcaagagcgccgtgatcaaggccacctacaaccacatctacgacaccggccccaccatcggcatcaacgtgatgcacgacgagcactgcaccggccagtgccccaccgacatcccccacaaggagaactggatcaccttcagccaggagagaaccagcagatggggctgcgaggagttcggctgcctggccgtgaacaccggctgcgtgttcggcagctgccaggacatcatcagacccgagaccaaggtgtacagaaaggccatcgaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcagactgctgaaggaggagcagagcctgatgttcgccgacaaccacgagaccatcgacgtggccaacgtgagacacctgctgggcgacctgcagttcaagctgatgctgggcgacctgagatacaagagcttcgccgaggaccccgacctggagatcgaggccaagtgcgtgggctgccccagctgcttcaccagctacagctgcaacttcagaatcgtgagcaacatcgacaccgtgtgcagcatcgagggcccctgcaccaccttccacaacagactgatgatcaccagcaccaagcaggactacggcatcaagatgagctgcaagggcaagcccggcagcaccgaggagttccagatctgcaagaagacctacaccgtgctgttcaccaccgtggagaagaacgacaagatcgagatcaacaccggcgaccagaccagcttcatccaggagagagacgacagatgcaagacctggctgtgcagagtgagagacgagggcatcagcgtggtgttcgagcccatcagagccttcttcggcagctacttcagcatcgccttctacatcgtggtgggcatcatcgtgctgttcctggtgatctacatcttcctgcccatggccttcaagctgagagacgtgctgaagagaaacgagtacctgtacctgcaggagatcaagcacaagtga

SEQ ID NO: 9241 - RNA, 4305 nt, synthetic construct
  misc_feature 1..4305: note = derived and/or modified CDS sequence (opt4) from BATV(Italy-2009)__KC168047.1__GP
  source 1..4305: mol_type = other RNA
atgctgctgttcctgatcctgctgatcccctgctacgccagcgccagccccgtggtgaccagatgcttccacggcggccagctgatcgccgagagcagaagccccaccgccgtgagcgagttctgcctgaaggacgacgtgagcaccatcaagagcgagatcatctacgtgaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgagcaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacagcaccatcctgcccggcaccatggccaccagcatctgccagaacatcgagctgatcatcatcatcagcctgaccctgctgatcttcatcctgatggccatcctgaccaagacctacatctgctacctgctgatgcccctgttcatgcccatcgcctacctgtacggctggagctacaacagaagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcaccgagaagggcatcaaggagtacgtggtgttctacaccagcatcttcggcggcctgttcctgctgctggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcaacgactgctgggccaagaagagcctggagatggagtgcatcggccccctgcagagagtggagagctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctggccaagcactgcgactactacaagagcttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctgctggagaacgccttccccggcaccaccgagagcttctactaccagatgctgcagaagaagaacaccaccggcgtggtgaagctgctggacgagctgaccaagaagttcggcaacaacaacatgttcgtgggcatctggaagttcggccagtacctgatgagcctgccctacatcaacgagaccagcctgacccccctgcagctgagcaagatcctggaggccagcaaccagcaccacagaagcatcagcggcagacaggagagcctggccaacgccgccagcggcggcaagagcaaggagtgcgacaacgccaagaaggtgagctgcatcagccccagattcggcgtgcccatggagggcctgatcgcctgcggcagcagccccaactacaagatctacaagatgcccaccaagctgtacaagagcaacaacaagggcgaggtgtggtgcagcggcgacgtgcactgcttccaggagctgaaccccgccagccaggagagcgtggacagaatcaagcagatgacctgcttcctgaccgagcccgagaccaacgaggacgtgttcagcatcgccatcagcatgtgcaaggtgagagacaagggcgtgtgcaccatcaacgaggagagatggaacgtgatcaagtgcgacagcggcctgatctactacaccgaccagagagacggccaggacaccggcaacgacttcggcgagtactgcctgagccacaactgcagaatcgagagattccccatcaaccccgccatcatcaacgactgcctgtgggagtaccacagcagaagaagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcaaggacaacttccccctgttcgacatcatcatcttcatcaagagcgccgtgatcaaggccacctacaaccacatctacgacaccggccccaccatcggcatcaacgtgatgcacgacgagcactgcaccggccagtgccccaccgacatcccccacaaggagaactggatcaccttcagccaggagagaaccagcagatggggctgcgaggagttcggctgcctggccgtgaacaccggctgcgtgttcggcagctgccaggacatcatcagacccgagaccaaggtgtacagaaaggccatcgaggagaacgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcagactgctgaaggaggagcagagcctgatgttcgccgacaaccacgagaccatcgacgtggccaacgtgagacacctgctgggcgacctgcagttcaagctgatgctgggcgacctgagatacaagagcttcgccgaggaccccgacctggagatcgaggccaagtgcgtgggctgccccagctgcttcaccagctacagctgcaacttcagaatcgtgagcaacatcgacaccgtgtgcagcatcgagggcccctgcaccaccttccacaacagactgatgatcaccagcaccaagcaggactacggcatcaagatgagctgcaagggcaagcccggcagcaccgaggagttccagatctgcaagaagacctacaccgtgctgttcaccaccgtggagaagaacgacaagatcgagatcaacaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtggtgggcatcatcgtgctgttcctgatgatctacatcttcctgcccatggccttcaagctgagagacgtgctgaagagaaacgagtacctgtacctgcaggagatcaagcacaagtga

SEQ ID NO: 9242 - RNA, 4305 nt, synthetic construct
  misc_feature 1..4305: note = derived and/or modified CDS sequence (opt4) from BATV(MM2222)__AB257763.1__GP
  source 1..4305: mol_type = other RNA
atgctgctgctgctggtgctgctgatcagctgctgcgtgagcgccagccccgtgatcaccagatgcttccacggcggccagctgatcgccgagagaaagagccagaccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcgtgttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacaacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatgatcctggtgtgcctgctgatcgcccagaacaccatcctgatcgtggccgccagcgacgactgctggaccaagaagagcctggagatggagtgcatcggccccctgcagcaggtggacacctgcgaggacaagaccagcagaagctacagcggcgaggccaagaagctggtgagagccagcaagatcagcgacctggacgccgcccaggtgggcctgctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcatctaccagagcaagagagacttcttcaagcacgacttcaagctgttctgcaccctgatcgaggacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccaccaccacagaagcatcagcggcagacaggagagcctggccagcgccaccagcggcagcaagagcagcgagtgcgaccacgccaagaaggtgagctgcatcagccccagattcggcgtgcccatggagggcctgatcgcctgcggcaacagccccaactacaagatctacaagacccccgccaagctgtacaagagcaacaacaagggcgaggtgtggtgcagcggcgacgtgcactgcttccaggagctgatccccgccagccaggagagcgtggacagaatcaagcagatgacctgcttcctgaccgagcccgaggtgaacgacgacgtgttcagcatcgccatcagcatgtgcaaggtgcaggacaagggcgtgtgcaccatcaacgaggacagatggaacgtgatcaagtgcgacagcggcctgatctactacaccgaccagagagagggccaggacaccggcaacgacttcggcgagtactgcctgagccacagctgcagaatcgagagattccccatcaaccccaccatcatcagcgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccggccccatcgaggagttccagatctgcaagaagacctacaccatcctgttcaccaccgtggagaagaacgacaagatcgagatcagcaccggcgaccagaccagcttcatccaggagaaggacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatgttcaagctgagagacgtgctgaagagaaacgagtacctgtacctgcaggagatcaagcacaagtga

SEQ ID NO: 9243 - RNA, 4305 nt, synthetic construct
  misc_feature 1..4305: note = derived and/or modified CDS sequence (opt4) from BATV(MM2222)__AY772534.1__GP
  source 1..4305: mol_type = other RNA
atgctgctgctgctggtgctgctgatcagctgctgcgtgagcgccagccccgtgatcaccagatgcttccacggcggccagctgatcgccgagagaaagagccagaccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcgtgttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacaacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatgatcctggtgtgcctgctgatcgcccagaacaccatcctgatcgtggccgccagcgacgactgctggaccaagaagagcctggagatggagtgcatcggccccctgcagcaggtggacacctgcgaggacaagaccagcagaagctacagcggcgaggccaagaagctggtgagagccagcaagatcagcgacctggacgccgcccaggtgggcctgctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcatctaccagagcaagagagacttcttcaagcacgacttcaagctgttctgcaccctgatcgaggacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccaccaccacagaagcatcagcggcagacaggagagcctggccagcgccaccagcggcagcaagagcagcgagtgcgaccacgccaagaaggtgagctgcatcagccccagattcggcgtgcccatggagggcctgatcgcctgcggcaacagccccaactacaagatctacaagacccccgccaagctgtacaagagcaacaacaagggcgaggtgtggtgcagcggcgacgtgcactgcttccaggagctgatccccgccagccaggagagcgtggacagaatcaagcagatgacctgcttcctgaccgagcccgaggtgaacgacgacgtgttcagcatcgccatcagcatgtgcaaggtgcaggacaagggcgtgtgcaccatcagcgaggacagatggaacgtgatcaagtgcgacagcggcctgatctactacaccgaccagagagagggccaggacaccggcaacgacttcggcgagtactgcctgagccacagctgcagaatcgagagattccccatcaaccccaccatcatcagcgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccggccccatcgaggagttccagatctgcaagaagacctacaccatcctgttcaccaccgtggagaagaacgacaagatcgagatcagcaccggcgaccagaccagcttcatccaggagaaggacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatgttcaagctgagagacgtgctgaagagaaacgagtacctgtacctgcaggagatcaagcacaagtga

SEQ ID NO: 9244 - RNA, 4305 nt, synthetic construct
  misc_feature 1..4305: note = derived and/or modified CDS sequence (opt4) from BATV(MM2222)__JX846596.1__GP
  source 1..4305: mol_type = other RNA
atgctgctgctgctggtgctgctgatcagctgctgcgtgagcgccagccccgtgatcaccagatgcttccacggcggccagctgatcgccgagagaaagagccagaccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcgtgttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacaacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatgatcctggtgtgcctgctgatcgcccagaacaccatcctgatcgtggccgccagcgacgactgctggaccaagaagagcctggagatggagtgcatcggccccctgcagcaggtggacacctgcgaggacaagaccagcagaagctacagcggcgaggccaagaagctggtgagagccagcaagatcagcgacctggacgccgcccaggtgggcctgctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcatctaccagagcaagagagacttcttcaagcacgacttcaagctgttctgcaccctgatcgaggacgccttccccggcaccaccgagagcctgttctacgagatgctgagcaagaagaacaccaccggcatcaccgagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccaccaccacagaagcatcagcggcagacaggagagcctggccagcgccaccagcggcagcaagagcagcgagtgcgaccacgccaagaaggtgagctgcatcagccccagattcggcgtgcccatggagggcctgatcgcctgcggcaacagccccaactacaagatctacaagacccccgccaagctgtacaagagcaacaacaagggcgaggtgtggtgcagcggcgacgtgcactgcttccaggagctgatccccgccagccaggagagcgtggacagaatcaagcagatgacctgcttcctgaccgagcccgaggtgaacgacgacgtgttcagcatcgccatcagcatgtgcaaggtgcaggacaagggcgtgtgcaccatcaacgaggacagatggaacgtgatcaagtgcgacagcggcctgatctactacaccgaccagagagagggccaggacaccggcaacgacttcggcgagtactgcctgagccacagctgcagaatcgagagattccccatcaaccccaccatcatcagcgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccggccccatcgaggagttccagatctgcaagaagacctacaccatcctgttcaccaccgtggagaagaacgacaagatcgagatcagcaccggcgaccagaccagcttcatccaggagaaggacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatgttcaagctgagagacgtgctgaagagaaacgagtacctgtacctgcaggagatcaagcacaagtga

SEQ ID NO: 9245 - RNA, 4305 nt, synthetic construct
  misc_feature 1..4305: note = derived and/or modified CDS sequence (opt4) from BATV(MS50)__JX846605.1__GP
  source 1..4305: mol_type = other RNA
atgaagatgctgaccctgatcatcatcgtgagctgctgggtggccaccctgcagaaccccctgatcagcagatgcttccacggcggccagctgatcgccgagaagaagagcctgaccagcatcagcgagttctgcatcaaggacgacgtgagcatgctgaagagcgaggtgatctaccagaagaacgacaccggcatctacggccacagcaaggtgttcagacactggaccatcgccgactggaagtactgcaaccccgtgcccaccgccggcggcagcatcaacgtgatcgagctggacaagaacctgaacctgatcgccaagaactacgtgtgcaccagagactgcaccatcaccgtggacaaggagaacgcccagatcgtgttccagaccgacaagctgaaccacttcgaggtgaccggcaccaccatcagcaccggctggttcaagaccaaggccagcgtggccctggacagaacctgcgagcacatcaaggtgagctgcggcaagaagaccctgcagttccacgcctgcttcaagcagcacatgagctgcgtgagattcctgcacagaagcatgctgcccggcagcatggccaacagcatctgccagaacatcgagctgatcatcatcatcaccctgaccctggtgatcttcatcctgatgctgatcgccaccagattctacatctgctacctgctgatccccgtgttcatgcccatcgcctacgcctacggctgggcctacaacagaagctgcaagaagtgcagctgctgcggcctggcctaccaccccttcaccaactgcggcagctactgcgtgtgcggcgccagattcgagaccagcgacagaatgagactgcacagagagagcggcctgtgccagggcttcaagagcctgagaatggccagaagactgtgcaagagcaagggcagcagcctggtgatcagcatcctgctggccaccctgatcctgagcttcgtgacccccatcgagggcaccatgaccaactaccccaccaacgagaagtacagcctggacgagatcgccgacgtgctgaagtggaaggagcaggagagcgagtacaagtactacgccatcctgtacgccagcatcatcggcgcctgcttcaccgtgctgttcgccggcaccgccctggccctgaacatcgtgctggagctgctgaccaagatcaacgtgatctactgcgaggagtgcagcatgtaccacagcaagagcaacatcaagtacatcggcgacttcaccaacaagtgcggcttctgcacctgcggcctgctggaggaccccgacggcgtggtggtgcacaaggtgaagagaagctgcacctaccagtacaagctgacctgggtgaagaccatcatgatcgtgctgagcatcctgttcctgctgcagaacatcatcgtgatcgtggccgccgacagcgactgctggaccaacgaggagctgaagcccgagtgcgtgggccccctgatcgcccccgccgactgcaccgagaaggacaagaagacctacctgaccgaggccgccgccctggtgaagaccaagaagatcagccaggtggacgccgacaacgtggagatcctgggcaagaccatcgagagcgccatcaaggccatcgagaagcagaagacctaccacagaatgcacctgctggaggccgtgttcctgaacaagcactgcgactactacaagctgttcgagcacaacagcggctacagccaggtgaagtggagaatgctggccaagacccagcacttcgacatctgcgccttcgccaaggagagcaagttctgcaagtgcatggccggcggcgcctgcgccgaggacagctgggacttcgacaccaccatgaacagcacctacaccagcaagggcgacaacttcaagcacgacatgagcctgttcctgaagatcttcgaggccgccttccccggcaccagctacgtgtacatgctgaacaagatcaaggagaagaagccctaccagagcgtgaccatgatcgacaagatcaagaccaagtaccccaacaacaagatgctggtggcctacctggagttcggcaagtgcctgatgggcgtgggccacgccagcaccttcgagctgcagcagagccagctggagagactgtaccagcccgccgagctgagcagaagcgtgggccagctgaccagcctgagcaacgcccaggtgggcaccatcaccaaggagtgcagcaagtacaaggacatcagctgcctgagccccagattcggcatccccatggagaacatggtggcctgcggcgacagccccaactacaagatctacaagaagcccatcaaggtgtacaaggcccacgacagagtggagacctggtgcatcaaggaccagcactgcctggtggactacacccccgccgaggccgacgtggtgaagaagctgaagaccatgaagtgctggctgaacgaccccggcaccgagaccgacgcctacaccaccgccatcaagagctgcagaatcatggacaagggcgtgtgcaccgtgaacggccagaagtggagcatcatcaagtgcgacagcgacctgctgtactacaccgaccacatcgagggcgaggacaccggcaacgacatcggccactactgcatcagcgtgggctgcaagaccgacagataccccatcaaccccgacatcgtgaccgactgcacctgggagttcaagagcagaaagagcagctacatcggcaagatcagcatgcagagcctggaggactacaagaaggccctgaccgacaagctgacccacaccctggagacctacagcttcgcccccaccgccgacctgccccacatcaagcccatctacaagtacatcaccgcccagggcgtggagaacagcgacggcatcgagggcgcctacatcaccgccaccatccccgccctgggcggcaccagcatcggctacagcgtgcagagcaaggacggcttccccctgctggacctgatcatctacatcaaggccgccgtgatcagaagcacctacatccacctgtacgacaccggccccaccatcagcatcaacaccaagcacgacgagaagtgcaccggccagtgccccgccgagatcgagcacgaggccaactggctgaccttcagccaggagagaaccagcagatggggctgcgaggagttcggctgcctggccatcaacaccggctgcgtgttcggcagctgccaggacgtgatcagacccgagaccaaggtgtacagaaagagcgtggaggaggaggtggtgctgaccgtgtgcatcaactaccccggcaacaccttctgcaccgagatcaacgccatcgagcccaagatcaccgaggaggtggagctgcagttcaagaccgtggacaccaagaccctgcccaccctgctggccgtgaccaaccacaagctgttcagcggccagatcaacgacctgggcaccttcggccagatgtgcggcaacgtgcagaagaccaacagcagcatcctgggcagcggcacccccaagttcgactacacctgccacggcgccagcagaaaggacatcatcgtgagaaagtgctacaacaacaactacgacagctgcaagctgctgaaggaggagaagcagctggtgttcaacgacgaccacgagaccatcaccgtggtgaacaacagacacctggtgggcgagctggccatcaagctgatcctgggcgacatccagtacaagctgttcaccgagaagctggacctgcagatcgacgccaagtgcgtgggctgccccgactgcttcgagagctacgcctgcaacttccagatcgtgagcaacatcgacaccgtgtgcgccatcaacggcccctgcgacatcttccacaacagaatcagcatcagaagcacccagcagaactacggcgtgaagatgagctgcaagagaacccccgaccagaacgagaagttcgtgatctgcggcagagagtacagcgtgttcttccacaccgtgcagaagaacgacaagatcgagatcaacaccggcgaccagaccagctacatcaaggagatggacaccagatgcaagacctggctgtgcagagtgagagacgagggcctgagcgtgatcttcgagcccatcaaggccttcttcggcagctacttcagcatcgccttctacatcgtgctgttcatcatcatcgccttcctggtgatctacatcttcatgcccatgttcatgaagctgagagacatcctgaagcagaacgagaagctgtacctgcaggagatcaagcagaagtga

SEQ ID NO: 9246 - RNA, 4305 nt, synthetic construct
  misc_feature 1..4305: note = derived and/or modified CDS sequence (opt4) from BATV(NM/12)__KJ187039.1__GP
  source 1..4305: mol_type = other RNA
atgctgctgctgctggtgctgctgatcccctgctgcgtgagcgccagccccgccatcaccagatgcttccacggcggccagctgatcgccgagagaaagagccagaccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttcagaaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccagaacctacatctgctacctgctgatgcccctgttcatgcccatcgcctacttctacggctggagctacaacaagagctgcaagaagtgccagtgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtggtggagaagggcatcaaggagtacgtggtgttctacaccagcatcttcggcgccctgttcctgctgatggccctgatcatcatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatgatcctggtgtgcctgctgatcgcccagaacaccatcctgatcgtggccgccagcgacgactgctggaccaagagaagcctggagatgggctgcatcggccccctgcagcaggtggacacctgcgacgacaagaccagcagaagctacagcggcgaggccaagaagctggtgagagccagcaagatcagcgacctggacgccgcccaggtgggcctgctgggcagcaccatcgagagcgccatcgccagcatcagaaagcagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccagcgagatgaacagcacctaccagagcaagagagacttcttcgagcacgacttcaagcagttctgcaccctgatcgagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccaccaccacagaagcatcagcggcagacaggagagcctggccagcgccgcccccggcagcaagagcagcgagtgcgaccacgccagaagagtgagctgcatcagccccagattcggcgtgcccatcgagggcctgaccgcctgcggcagcagccccaactacaagatctacaagacccccgccaagctgtacaagagcaacaacaagggcgaggtgtggtgcagcggcgacgtgcactgcctgcaggagctgatccccgccccccaggagagcgtggacagaatcaagcagatgacctgcttcctgaccgagcccggcgtgaacgacgacatcttcagcatcgccatcagcatgtgcaaggtgcaggacaagggcgtgtgcaccatcaacgaggacagatggaacgtggtgaagtgcgacagaggcctgatctactacaccgaccagagagagggccaggacaccggcaacgacttcggcaagtactgcctgagccacagctgcagaatcgagagattccccatcaaccccgccatcatcaacgactgcctgtgggagtaccacagcagaaagagcaagtacatcaccagcctggacctggagagcctggaggagttcaagagagccatcagcgagaagctgagccacaccctgatcgtgcacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatccacgacgagcactgcaccggccagtgccccaccgacatcccccacaaggagaactggatcaccttcgcccaggagagaaccagcagatggggctgcgaggagttcggctgcctggccatcaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccatcttccacagcagactgatgatcaccagcaccaagcaggactacggcatcaagatgagctgcaagaccaagcccggccccaccgaggagttccagatctgcaagaagacctacaccatcctgttcaccaccatcgagaagaacgacaagatcgagatcagcaccggcgaccagaccagcttcatccaggagagagacgacagatgcagaacctggctgtgcagagtgagagacgagggcatcggcgtgatcttcgagcccatcagagccttcttcggcagctacttcagcatcgccttctacatcgtgatcggcatcatcatcctgttcctggtgatctacatcttcctgcccatggtgttcaagctgagagacgtgctgaagagaaacgagtacctgtacctgcaggagatcaagcacaagtga

SEQ ID NO: 9247 - RNA, 4305 nt, synthetic construct
  misc_feature 1..4305: note = derived and/or modified CDS sequence (opt4) from BATV(ON-1/E/94)__AB257764.1__GP
  source 1..4305: mol_type = other RNA
atgctgctgttcctggtgctgctgatcagctgctacgtgagcgccagccccgtgatcaccagatgcttccacggcggccagctgatcgccgagagaaagagccagaccgccatcagcgagttctgcctgaaggacgacgtgagcaccatcaagagcgagatcatctacgagaagaacgacaccggcctgttcgcccacagcaaggtgctgagaaactggatcatcaaggactggaagaactgcaaccccgtgcccaccgccggcggcagcatcaacgtgatcgaggtgaacgccgacctgagcctggccaccaagacctacgtgtgcagcagagactgcaccatcaccgtggacaaggaggacgcccagatcgtgttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatcatcctggtgtgcctgctgatcgcccagaacaccatcctgatcgtggccgccagcgacgactgctggaccaagaagagcctggagatggagtgcgtgggccccctgcagcaggtggacacctgcgaggacaagaccagcagaagctacagcggcgaggccaagaagctggtgagagccagcaagatcagcgacctggacgccgcccaggtgggcctgctgggcagcaccatcgagagcgccatcgccagcatcagaaagcagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagagagacttcttcgagcacgacttcaagctgttctgcaccctgatcgagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccacctgcacagaagcatcagcggcagacaggagctgctgaccagcgccacccccggcagcaagagcagcgagtgcgaccacgccaagaaggtgagctgcatcagccccagattcggcgtgcccatggagggcctgatcgcctgcggcaacagccccagctacaagatctacaagacccccaccaagctgtacaagagcaacaacaagggcgaggtgtggtgcagcggcgacgtgcactgcttccaggagctgatccccgccagccaggagagcgtggacagaatcaagcagatgacctgcttcctgaccgagcccgaggtgagcgacgacgtgttcagcatcgccatcagcatgtgcaaggtgcaggacaagggcgtgtgcaccatcaacgaggacagatggaacgtgatcaagtgcgacagcggcctgatctactacaccgaccagagagagggccaggacaccggcaacgacctgggcgagtactgcctgagccacagctgcagaatcgagagattccccatcaaccccatcatcatcagcgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcgtggtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccggccccaccgaggagttccagatctgcaagaagacctacaccatcctgttcaccaccgtggagaagaacgacaagatcgagatcagcaccggcgaccagaccagcttcatccaggagaaggacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatgatcttcaagctgagagacgtgctgaagagaaacgagtacctgtacctgcaggagatcaagcacaagtga

SEQ ID NO: 9248 - RNA, 4305 nt, synthetic construct
  misc_feature 1..4305: note = derived and/or modified CDS sequence (opt4) from BATV(ON-7/B/01)__AB257765.1__GP
  source 1..4305: mol_type = other RNA
atgctgctgctgctggtgctgctgatcccctgctgcgtgagcgccagccccgtgatcaccagatgcttccacggcggccagctgatcgccgagagaaagagccaggccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcccctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgttcctgctgatcgccctgatcgtgatcatcgccctgaacagagtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaaggtgatcatgatgatcctggtgtgcctgctgatcgcccagaacaccatcctgatcgtggccgccagcgacgactgctggaccaagaagagcctggagatgggctgcatcggccccctgcagcaggtggacacctgcgacgacaaggccagcagaagctacagcggcgaggccaagaagctggtgagagccagcaagatcagcgacctggacgccgcccaggtgggccagctgggcagcaccatcgagagcgccatcgccagcatcagaagacagagaacctacagcaccatgcacctgctggagagcgtgttcctgggcaagcactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagagagacttcttcgagcacgacttcaacctgttctgcaccctgatcgagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatcagcctgccctacgtgaacgagaccagcctgagccccacccagctggccaaggtgctggtggtgaccgaccagcaccacagaagcatcagcggcagacaggagagcctggccagcgccacccccggcagcaagagcagcgagtgcggccacgccaagaaggtgagctgcatcagccccagattcggcgtgcccatggagggcctgatggcctgcggcagcagccccaactacaagatctacaagacccccgccaagctgtacaagagcaacaacaagggcgaggtgtggtgcagcggcgacgtgcactgcttccaggacctgatccccgccagccaggagagcgtggacagaatcaagcagatgacctgcttcctgaccgagcccgaggtgaacgacgacgtgttcagcatcgccatcgccatgtgcaaggtgcaggacaagggcgtgtgcaccatcaacgaggacagatggaacctgatcaagtgcgacagcggcctgatctactacaccgaccagagagagggccaggacaccggcaacgacttcggcgagtactgcctgagccacaactgcaagatggagagattccccatcaaccccgccatcatcagcgactgcctgtgggagtaccacagcagaaagagcaagtacatcaccagcctggacctggagagcctggaggagttcaagagagccatcagcgagaagctgagccacaccctggtggtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacctgagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcaacttcaagatcgtgagcaacatcgacaccgtgtgcagcatcgagggcccctgcaccaccttccacaacagactgatgatcaccagcgccaagcaggactacggcatcaagatgagctgcaagaccaagcccggcctgaccgaggagttccagatctgcaagaagacctacaccgtgctgttcgccaccgtggagaagaacgacgagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacatcgtgatcggcatcatcgtgctgttcctggtgatctacatcttcctgcccatggtgttcaagctgagagacgtgctgaagagaaacgagtacctgtacctgcaggagatcaagcacaagtga

SEQ ID NO: 9249 - RNA, 4305 nt, synthetic construct
  misc_feature 1..4305: note = derived and/or modified CDS sequence (opt4) from BATV(UgMP-6830)__DQ436460.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgttcctgctgatggccctggtgatcatcatcgccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatgatcctggtgtgcctgctgatcgcccagaacaccatcctgatcgtggccgccagcgacgactgctggaccaagaagagcctggagatggagtgcatcggccccctgcagcaggtggacacctgcgacgacaagagcagcagaagctacagcggcgaggccaagaagctggtgagagccagcaagatcagcgacctgaacgccgcccaggtgggcctgctgggcagcaccatcgagagcgccatcgccagcatcagaaagcagagaacctacagcaccatgcacctgctggagagcgtgttcctgggcaagcactgcgactactacaaggccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacctgaagctgttctgcaccctggtggagaacgccttccccggcaccaccgagagcctgttctacgagatgctgagcaagaagaacaccaccggcgtgaagaagctgctggacaagctgaccaagaagttcggcaacaacaacatgttcgtgggcatctggaagttcggccagtacctgatgagcctgccctacgtgaacgagaccagcctgacccccgcccagctggccaagatcctggaggtgaccgaccagcaccacagaagcatcagcggcagacaggagagcctggccagcgccacccccggcagcaagagcaaggagtgcggccacgccaagaaggtgagctgcatcagccccagattcggcgtgcccatggagggcctgctggcctgcggcgacagccccaactacaagatctacaagacccccgccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccatctacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccgaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtggtgagcatcatcgtgctgttcctggccatctacatcttcctgcccatggtgttcaagctgagagacgtgctgaagaagaacgagtacctgtacctgcaggagatcaagcacaagtga

SEQ ID NO: 9250 - RNA, 4305 nt, synthetic construct
  misc_feature 1..4305: note = derived and/or modified CDS sequence (opt4) from BATV(ZJ2014)__KU746870.1__GP
  source 1..4305: mol_type = other RNA
atgctggtgctgctggtgctgctgatcccctgctgcgtgagcgccagccccgccatcaccagatgcttccacggcggccagctgatcgccgagagaaagagccagaccgccatcagcgagttctgcctgaaggacgacgtgagcaccatcaagagcgagatcatctacgagaagaacgacaccggcctgttcgcccacaacaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccagaacctacatctgctacctgctgatgcccctgttcatgcccatcgcctacttctacggctggagctacaacaagagctgcaagaagtgccagtgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcgtggtggagaagggcatcaaggagtacgtggtgttctacaccagcatcttcggcgccctgttcctgctgatggccctgatcgtgatcatcgccctgaacagagtgaccgagtacctgaccaacatcaacgtgttctactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgatgatcctggtgtgcctgctgatcgcccagaacaccatcctgatcgtggccgccagcgacgactgctggaccaagaagagcctggagatgggctgcatcggccccctgcagcaggtggacacctgcgacgacaagaccagcagaagctacagcggcgaggccaagaagctggtgagagccagcaagatcagcgacctggacgccgcccaggtgggcctgctgggcagcaccatcgagagcgccatcgccagcatcagaaagcagagaacctacagcaccatgcacctgctggagagcgtgttcctgggcaagtactgcgactactacaaggtgttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccagcgagatgaacagcacctaccagagcaagagagacttcttcgagcacgacttcaaggtgttctgcaccctgatcgagaacgccttccccggcaccaccgagagcctgttctacgagatgctgagcaagaagaacaccaccggcatcaccaagctgctggacaagctgaccaagaagttcggcaacaacaacatgttcgtgggcatctggaagttcggccagtacctgatgagcctgccctacgtgaacgagaccagcctgagccccacccagctggccaaggtgctggaggtgaccgaccaccaccacagaagcatcagcggcagacaggagagcctggccagcgccgcccccggcagcaagagcagcgagtgcgaccacgccaagaaggtgagctgcatcagccccagattcggcgtgcccatcgagggcctgaccgcctgcggcagcagccccaactacaagatctacaagacccccgccaagctgtacaagagcaacagcaagggcgaggtgtggtgcagcggcgacgtgcactgcctgcaggagctgatccccgccagccaggagagcgtggacagaatcaagcagatgacctgcttcctgaccgagcccggcgtgaacgacgacatcttcagcatcgccatcagcatgtgcaaggtgcaggacaagggcgtgtgcaccatcaacgaggacagatggaacgtggtgaagtgcgacagcggcctgatctactacaccgaccagagagagggccaggacaccggcaacgacttcggcgagtactgcctgagccacagctgcagaatcaagagattccccatcaaccccgccatcatcaacgactgcctgtgggagtaccacagcagaaagagcaagtacatcaccagcctggacctggagagcctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcaccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatccacgacgagcactgcaccggccagtgccccaccgacatcccccacaaggagaactggatcaccttcgcccaggagagaaccagcagatggggctgcgaggagttcggctgcctggccatcaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgacggcccctgcaccatcttccacaacagactgatgatcaccagcaccaagcaggactacggcatcaagatgagctgcaagaccaagcccggccccaccgaggagttccagatctgcaagaagacctacaccatcctgttcaccaccatcgagaagaacgacaagatcgagatcagcaccggcgaccagaccagcttcatccaggagagagacgacagatgcagaacctggctgtgcagagtgagagacgagggcatcagcgtgatcttcgagcccatcagagccttcttcggcagctacttcagcatcgccttctacatcgtgatcggcatcatcatcctgttcctggtgatctacatcttcctgcccatggtgttcaagctgagagacgtgctgaagagaaacgagtacctgtacctgcaggagatcaagcacaagtga

SEQ ID NO: 9251 - RNA, 4305 nt, synthetic construct
  misc_feature 1..4305: note = derived and/or modified CDS sequence (opt4) from CVV__AF082576.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgccagtgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcatctggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagcccccagttcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacaccctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgagcaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9252 - RNA, 4305 nt, synthetic construct
  misc_feature 1..4305: note = derived and/or modified CDS sequence (opt4) from CVV(Montgomery County/VA/2015 4b)__KX583998.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacaccaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgaacagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaacagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccagaagaaacgtgatctactgcgaggagtgcagcatgtaccacagcaagagaggcatcaagtacaacggcgacttcaccaacaagtgcggcttctgcacctgcaacgagcaggaggacgccgagggcctggtgatccacaaggtgagcaagagatgcacctacaagtaccagctgaagtgggccaaggtgctgatggtgaccctggtgctgctgctgatcgcccagaacaccatcctgatcgtggccgccggcaccgactgctgggccaagaagagcctggacatggactgcatcggccccatgctggacatcggcagctgcaccaacaagaacaccagaaactacgacaccgaggcccagaagctggtgagccagagcaaggtgagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaagatcctgggcaagctgatcaccaagtacggcaacaacaacatgttcgtgggcgtgtggaagttcggccagtacctgctgaccctgccctacatcaacaacaccgagctgagccagaacagaagacagaccatcctggccacccaggagagcctgagcagaagccacagcggcagacaggagagcatgagcagcgccatccagggcagcgtgaccaaggagtgccacaacgccaaggacgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaaggtgaagaagctgacctgcttcctgaccgacgtgagcgtgaagaccgacatcttcagcgtggccgtgagcacctgcaagatggccgacaagggcacctgcaccgtgaaggacgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatgaccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatcaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccgtggagcccaagatcaccgacgagatcgagctgcagttcaagaccgtggacaccaagaccctgcccaacctgctggccgtgcagaacagaaagctgtacagcggccagatcaacgacctgggcagcttcagccagggctgcggcaacgtgcagaagaccaaccacagcatcctgggcatgggcaccgccaagttcgactacgtgtgccacggcgccagcagaaaggacgtgatcgtgagaagatgctacaacaacaacttcgacagctgcagactgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9253 - RNA, 4305 nt, synthetic construct
  misc_feature 1..4305: note = derived and/or modified CDS sequence (opt4) from CVV(Montgomery County/VA/2015 K)__KX583999.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacaccaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgaacagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaacagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccagaagaaacgtgatctactgcgaggagtgcagcatgtaccacagcaagagaggcatcaagtacaacggcgacttcaccaacaagtgcggcttctgcacctgcaacgagcaggaggacgccgagggcctggtgatccacaaggtgagcaagagatgcacctacaagtaccagctgaagtgggccaaggtgctgatggtgaccctggtgctgctgctgatcgcccagaacaccatcctgatcgtggccgccggcaccgactgctgggccaagaagagcctggacatggactgcatcggccccatgctggacatcggcagctgcaccaacaagaacaccagaaactacgacaccgaggcccagaagctggtgagccagagcaaggtgagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaagatcctgggcaagctgatcaccaagtacggcaacaacaacatgttcgtgggcgtgtggaagttcggccagtacctgctgaccctgccctacatcaacaacaccgagctgagccagaacagaagacagaccatcctggccacccaggagagcctgagcagaagccacagcggcagacaggagagcatgagcagcgccatccagggcagcgtgaccaaggagtgccacaacgccaaggacgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaaggtgaagaagctgacctgcttcctgaccgacgtgagcgtgaagaccgacatcttcagcgtggccgccagcacctgcaagatggccgacaagggcacctgcaccgtgaacgacgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatgaccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatcaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccgtggagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgccaagttcgactacgtgtgccacggcgccagcagaaaggacgtgatcgtgagaagatgctacaacaacaacttcgacagctgcagactgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9254 - RNA, 4305 nt, synthetic construct
  misc_feature 1..4305: note = derived and/or modified CDS sequence (opt4) from CVV(1156)__EU583730.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaagatcagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctgaccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtgatcggcatcatcgtgctgttcctgatcatctacatcttcctgcccatgttcttcaagctgaaggacgtgctgaagagaaacgagtacctgtacctgcaggagctgaagcacaagtga

SEQ ID NO: 9255 - RNA, 4305 nt, synthetic construct
  misc_feature 1..4305: note = derived and/or modified CDS sequence (opt4) from CVV(6V633)__KX100134.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcatctggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacaccctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9256 - RNA, 4305 nt, synthetic construct
  misc_feature 1..4305: note = derived and/or modified CDS sequence (opt4) from CVV(807270)__AF186243.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgccagtgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9257 - RNA, 4305 nt, synthetic construct
  misc_feature 1..4305: note = derived and/or modified CDS sequence (opt4) from CVV(856 clone 1)__EU583732.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcgccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggatcaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagagaaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctgaccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtgatcggcatcatcgtgctgttcctgatcatctacatcttcctgcccatgttcttcaagctgaaggacgtgctgaagagaaacgagtacctgtacctgcaggagctgaagcacaagtga

SEQ ID NO: 9258 - RNA, 4305 nt, synthetic construct
  misc_feature 1..4305: note = derived and/or modified CDS sequence (opt4) from CVV(856 clone 3)__EU583731.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcgccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggatcaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagagaaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctgaccacccacgagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtgatcggcatcatcgtgctgttcctgatcatctacatcttcctgcccatgttcttcaagctgaaggacgtgctgaagagaaacgagtacctgtacctgcaggagctgaagcacaagtga

SEQ ID NO: 9259 - RNA, 4305 nt, synthetic construct
  misc_feature 1..4305: note = derived and/or modified CDS sequence (opt4) from CVV(CK102)__AF186242.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtggtgagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacaccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacctgcccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcagcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9260 - RNA, 4305 nt, synthetic construct
  misc_feature 1..4305: note = derived and/or modified CDS sequence (opt4) from CVV(CK-102)__KX100146.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtggtgagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacaccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtggagtgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacctgcccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9261 - RNA, 4305 nt, synthetic construct
  misc_feature 1..4305: note = derived and/or modified CDS sequence (opt4) from CVV(MI80-1-450)__AF186241.1__GP
  source 1..4305: mol_type = other RNA
atgctgttcctgctgatcctggccttcctgggcttcagcaccagcaaccccatcgccaccagatgcttccacggcggccacctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcaactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagccaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9262 - RNA, 4305 nt, synthetic construct
  misc_feature 1..4305: note = derived and/or modified CDS sequence (opt4) from CVV(MI80-1-450)__KX100149.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcaactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagccaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9263 - RNA, 4305 nt, synthetic construct
  misc_feature 1..4305: note = derived and/or modified CDS sequence (opt4) from CVV(MNZ-92011)__KC436107.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacaccaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgaacagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaacagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccagaagaaacgtgatctactgcgaggagtgcagcatgtaccacagcaagagaggcatcaagtacaacggcgacttcaccaacaagtgcggcttctgcacctgcaacgagcaggaggacgccgagggcctggtgatccacaaggtgagcaagagatgcacctacaagtaccagctgaagtgggccaaggtgctgatggtgaccctggtgctgctgctgatcgcccagaacaccatcctgatcgtggccgccggcaccgactgctgggccaagaagagcctggacatggactgcatcggccccatgctggacatcggcagctgcaccaacaagaacaccagaaactacgacaccgaggcccagaagctggtgagccagagcaaggtgagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccgccggcgccagcaagatcctgggcaagctgatcaccaagtacggcaacaacaacatgttcgtgggcgtgtggaagttcggccagtacctgctgaccctgccctacatcaacaacaccgagctgagccagaacagaagacagaccatcctggccacccaggagagcctgagcagaagccacagcggcagacaggagagcatgagcagcgccatccagggcagcgtgaccaaggagtgccacaacgccaaggacgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaaggtgaagaagctgacctgcttcctgaccgacgtgagcgtgaagaccgacatcttcagcgtggccgccagcacctgcaagatggccgacaagggcatctgcaccgtgaacgacgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatgaccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatcaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccgtggagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgccaagttcgactacgtgtgccacggcgccagcagaaaggacgtgatcgtgagaagatgctacaacaacaacttcgacagctgcagactgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9264 - RNA, 4305 nt, synthetic construct
  misc_feature 1..4305: note = derived and/or modified CDS sequence (opt4) from CVV(MPB1-1551)__KX100143.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagatcctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtgatcaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacaccctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacagctactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9265 - RNA, 4305 nt, synthetic construct
  misc_feature 1..4305: note = derived and/or modified CDS sequence (opt4) from CVV(W308-67)__KX100140.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgaccctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacgagaccaagtgccagaacggcgactgggacttcgccggcgagatgaacgagacctacaagagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagatcctgagcagaagctacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtgatcaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacaccctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgctacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9266 - RNA, 4305 nt, synthetic construct
  misc_feature 1..4305: note = derived and/or modified CDS sequence (opt4) from CVV(W728-67)__KX100137.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaagatcctgggcaagctgatcaccaagtacggcaacaacaacatggtggtgggcgtgtggaagttcggccagtacctgctgaccctgccctacatcaacaacaccgagctgagccagaacagaagactgaccatcctggccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacaccctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9267 - RNA, 4305 nt, synthetic construct
  misc_feature 1..4305: note = derived and/or modified CDS sequence (opt4) from CVV(WI-03BS7669)__KX100152.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatcctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggatcaagaagagcctggacatcgactgcatcggccccatgctggacatcggcagctgcaccaacaagaacaccagaagctacgacaccgaggcccagaagctggtgagccagagcaagatcagccagctggacgccgaccaggtgagcctgctgggcaacagcatcgacagcgccatcaaggccatcagagcccagaagacctacagcaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctgaccacccaggagctgctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9268 - RNA, 4317 nt, synthetic construct
  misc_feature 1..4317: note = derived and/or modified CDS sequence (opt4) from CHLV(CHLV-Mex07)__JN808310.1__GP
  source 1..4317: mol_type = other RNA
atggagcccagcatcaagctgttcctgatcctggccatcgccgccgccgccgtgcacagcctgcccgccagcagatgcttcagcgagggcatcgtgatcaaggagaagcaggacagcaaggccgtgagcgagttctgcctgaaggacgacgtgagcatgatcaagagccacgtggtgtacagcaagaacgagagcggcatcttcgccaacagccagatcctgagaaagtggatcatcaaggactggaagctgtgcagccccctgcccaccgccggcggccagatcaacgtgatcgagatcaaccacgacctgaccctgagcaccaagacctacgtgtgcaccaccgactgcaccatcggcatcgacaaggagaacgcccagatcaccttccagaccaacaagctgaactacttcgaggtgagcggcaccaccatcagcagcggctggttcaagagcaagaccagcgtgagcctggaccagacctgcgagcacctgaaggtgagctgcggcaagaagagcatgcagttccacgcctgcttcaagcagcacatgagctgcatcagatacctgcacagaaccgccctgcccggctacatggccgccagcatctgcagcaacatcgagctgatcatcatgaccaccctgaccctggccatcttcatcctgctgtgcatcatcaccaagacctacatctgctacctgctgatgcccctgttcatgcccatcgcctacatctacggctggctgtacaacaagagctgcaagaagtgcaactgctgcggcctgagctaccaccccttcaccaactgcggcagctactgcgtgtgcggcgccaagttcgagaccagcgacagaatgagaatccacagagagagcggcctgtgccagggctacaagagcctgagagtggccagaaagctgtgcaagagcaagggcagcagcctggtgatcagcatcaccctgagcgtgttcatcttcagcttcatcacccccatcggcggcgccatcatcaacgacaagctgagcgaggagaagtacagcatcaaccagatgatggacgccatcgtggacctggagaacttcagccacaacgtgagcggcacccagcaggtgatcagcgtgatcttcctgctgatcagctgcctgttcctgctgctgacctaccacctgaacaagatcatccagcacctggccagattcggcctgctgttctgcgaggagtgcagcatgtaccacagcaagaaggacatcaagtacaacggcgacttcaccaacaagtgcggcttctgcacctgcggccagcccgaggaccccgagggcctgaacctgcacatcctgagccagaactgcacctacaagcagcagttcaagtgggtgaagatcatcatcagcatcctgctgagcctgatcatcatcgagaacagcatgatcctggccgccgccgagaccgactgcttcagcgagaagcagatcagcgagttctgcctgggccccctgctgagcatcagcagctgcgaggacaagaacagcagaaccttcaagggcgaggcccagaagctggtggccctgaagaagatcaccagcgacgaggccatgctgatcgagagcatgggcgccaacgtggagggcgccctggagatgatccaggcccagaagagccccgacagcatgtacaccatggagtacgtgttcctgaacacctactgcgactactacagcctgttcgagcacaacagcggctacagccaggtgaagtggagatacatcctgaagacccaccagttcgacgcctgcgccagacacagcaacagccacttctgcagatgcatgagcgacggcatgcactgccccagcagcgactgggacatcgccgacgagctggacaacacctacatcaccaagcccaacttcttcaagcacgactacaacctgctgctggacgtgatcaccgccgccttccccggcaccggcgccgtgttcgtgatcgacgcctgcaagaaggccaacgccaccgccatcaagaccttcagcaacaacatcatcgccagattcccctacaacaacctgctgaagggcgtgatgaagttcctgcagtacatcagcaagcaccccagcttcaagaagtaccagcccgacaccagacactacgacctgatccccgtggcccccaccgccagaggcagaagcctgggcagaagcaacagctacaacaacgcccagatcggcagccccaccaaggactgccagatgctgaaggaggtgggctgcctgagccccaagttcggcctgcccctggagagcatcatcagctgcggcagcagccccaactacaagctgtacaagaagccccagaagtactacaagagcaacaacaaggagaacacctggtgcagcaaggacgtgcactgcctgcacgacttcgagcccatcaccgaggacgtgctggagaaggtgaaggtgatgacctgctgggagatcgagcccggcaccatcgaggacatcttcaccatcgccagcgagacctgcaagatcaacgacagaggcgtgtgcgaggtgaacgccgccaagtggaagatcgtgaagtgcgagaccggcctgtactactacaccgaccacagagagggcgacgacaccggcagcgacctgggccactactgcctgacccacaagtgcgccggcggcagataccccatcaaccccgagatcctgcagaactgcgtgtgggagttccacagccagaagagccagtacatcaaccaggtggacctggagcagatcgaggagtacaagaaggccctgaccgagaagctgacccacaccctgaaccactacaacttcctgcccaccaagaacctgccccacatcagccccaactacaagtacgtgaccctgaacggccaggagaccagcgacggcatcgagaacagctacatcgtgagcgagatccccgccatcgccggcaccagcatcggcctgaaggtgcagaccaagaccaacgacgacatcttcgacctgatcatctacgtgaagagagccgacatcatcgccagctacaaccacatctacgacaccggccccaccatcggccacaacgtggagcacgaggagctgtgcaccggccagtgcccccagcacatccccgccaaggccaactggctgaccttcagccaggagagaaccagcagatggggctgcgaggagttcggctgcctggccatcaacaccggctgcgtgtacggcagctgccaggacatcatcaagcccgtggccaaggtgtacagaaagagcaccgaggagaaggtggagctggagctgtgcatcgtgctgcccgacaagaacttctgcaccaccctgaacgccctggagcccaagatcaccgaggagatcgagctgcagttcaagaccatcgaccagatgagcctgcccaacatcgtgctgctgagagaccacaagctgttcaagggccagatcaacgacctgggcaccttcggccagaactgcggcaacgtgcagaagaccaaccagagcatcctgggcgccggcaccgtgagattcgactacctgtgccacagcgccagcagaaaggacatcatcatcagaagatgctacaacaacaactacgacagctgcaaccacctgcagctggccgagagcctgatcttcctggacaaccacgagaccctggaggtgagaaagcccaaccacatcctgggcaccctgagcatgaagctgatgctgggcgacttccagtacaagaccttcgccaaggacatcgagctggacttcaccggcagatgcgtgggctgcatcggctgcttcgagggcttcgtgtgcgagatgcacatcaccaccaccgtggaggccacctgcaacctggaggccagctgccagttcttccacaaccagctgcacatcaagcccgacgtgctgaagtactacaccaagatgacctgccagaccgacgagtacatccccagcaagatcaagatctgcaacaaggagtacaagatcaccgtgggcaaggtgcagaagaacgacaagatcgagatcgacaacagcgaccagaccagctacatcaaggagaaggacgagagatgcaagacctggctgtgcagagtgagagacgagggcatcagcgtgatcttcgagcccctgctgaacatcttcggcaactacggcagaatcgccgtggccgtgatcagcgccatcctggccctgatcatcctggtgtacatcctgatgcccatctgcatgagaatcagagacatcctgaagaccaacgagagagagttcctgatcgagagcaagtacaagtga

SEQ ID NO: 9269 - RNA, 4305 nt, synthetic construct
  misc_feature 1..4305: note = derived and/or modified CDS sequence (opt4) from FSV(86MSP18)__KX100131.1__GP
  source 1..4305: mol_type = other RNA
atgctgagcctgctgatcctggccctgctgggcctgagcaccagcaaccccatcgccaccagatgcttccacggcggccagctgatcgccgagagcaagagcgccaccagcatcagcgagttctgcctgaaggacgacgtgagcatgctgaagagcgaggtgatctacaccaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgatcaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccaactaccccgacagcagaaagtacaccctggaggagatcaccgacgtggtggagggcctgatcagcgagcagaacatcaaggagtacatcgtgttctacaccagcctgttcggcagcctgatcctgctgctggccttcatcatgagcatcaccctgagcaagatcaccagcatcctggccagaagaaacgtgatctactgcgaggagtgcagcatgtaccacagcaagagaggcatcaagtacaacggcgacttcaccaacaagtgcggcttctgcacctgcaacgagcaggaggacgccgagggcgtggtgatccacaaggtgagcaagagatgcacctacaagtaccagctgaagtgggccaaggtgctgatgatcaccctggtgctgctgctgatcgcccagaacaccatcctgatcgtggccgccgagaccgactgctgggccaagaagagcctggacatcaactgcatcggccccatgctgaacatcggcagctgcaccaacaagaacaccagaagctacgacaccgaggcccagaagctggtgagccagagcaaggtgagccagctggacgccgaccaggccagcctgctgggcagcagcatcgacagcgccatcaaggccatcagagcccagaagacctaccccgccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacctgcacgacctgaacctgttctacaccatcttcgagaacgccttccccggcaccaccgagagcctgttctaccagctgatccagaagagaaacaccatcggcgccagcaaggtgctgggcaagctgatcaccaagtacggcgacaacaacatgttcgtgggcgtgtggaagttcggccagtacctgctgaccctgccctacatcaacaacaccgagctgagccagaacagaagacagaccatcctggccgcccaggagctgagcagcagaagccaccccggcagacaggagagcatgagcagcgccatccagggcagcgtgaccaaggagtgccacaacgccaaggacgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaaggtgaagaagctgacctgcttcctgaccgacgtgagcgtgaagaccgacatcttcagcgtggccgccagcacctgcaagatggccgacaagggcgtgtgcaccgtgaacgacgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatgaccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcgtgaagagcgccgtgatcagaaccacctacaaccacatctacgacaccggccccaccatcggcatcaacacccagcacgacgagcactgcaccggcccctgccccgccgtggtgccccacaaggagaactggatcaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgccaagttcgactacgtgtgccacggcgccagcagaaaggacgtgatcgtgagaagatgctacaacaacaacttcgacagctgcaagctgctgaaggaggagaccagcctggtgttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccagcaagcagagctacggcctgaagatgagctgccagaccaagcccagccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcaaggtgagagacgagggcatcagcgtgctgttcgagcccctgaaggccttcttcggcagctacttcagcatcatcttctacgtggtggtgggcatcatcgtgctgttcctggtgatctacatcttcctgcccatgttcttcaagctgaaggacgtgctgaagaagaacgagtacctgtacctgcaggagctgaagcacagatga

SEQ ID NO: 9270 - RNA, 4314 nt, synthetic construct
  misc_feature 1..4314: note = derived and/or modified CDS sequence (opt4) from GERV__M21951.1__GP
  source 1..4314: mol_type = other RNA
atggccatcagcaccagcctgctgatcgtggccctgctgatcaagctgtgcctggtgaacaccgccccccccatcagcaagtgcttccaggacggcatcctgatcgccgagctgaagagcagcagcggcatcagcgagttctgcatcaaggacgacatcagcatcctgaagagcgagatcacctacagcaagaacgacaccggcatcttcatgcacagcaaggtgttcagacactggaccgtggccgactggaagcagtgcaaccacaccagcgccggcggcagcaccaacgtgctggaggtggacaagaacctgaacctggtggccaagaactacatgtgcaccagaccctgcgtgatcaccatcgacaaggagaacgcccagctgctgttccagaccgagcagctgaaccagttcgaggtgaccggcaccaccatcagcaccggctggttcaagagcaagaccagcgtgagcctggacaacacctgcgagcacatcaaggtgacctgcggcaagaagagcctgcagttccacgcctgcttcaagcagcacatgagctgcgtgagattcctgcacagaagcgtgctgcccggctacatggccagcagcatctgccagaacatcgagctgatcatcatcatcatcctgaccctggccatcttcatcttcatgtgcatcatcaccagaacctacatctgctacctgatgctgcccctgttcgcccccatcgcctacctgtacggctggctgtacaacagaagctgcaagaagtgcatctgctgcggcctggcctaccaccccttcaccaactgcggcagctactgcgtgtgcggcagcagattcgagaccagcgacagaatgagactgcacagagagagcggcctgtgccagggcttcaagagcctgagagtggccagaagcctgtgcaagagcaagggcagcagcctggtgatcagcatcctgaccgccatgctgatcctgagcttcatcacccccctggaggccatgaccaccaactaccccgacgacaagaagttcaccctgaaggaggtgaacgacatcgtgctgggcagagacatggagcaggagctgaagagcagcatcctgatcctgatgagcatctgcggcatcggcatcatcctgatcttcttcggcctgaccgtgctgctggagatcgtgctggagctgatcgccaagagaagcaccatcttctgcaaggagtgcaacctgatccacgacaagaagagcatgacctacagaggcgacttcaccaacaagtgcggcttctgcccctgcggcgagctggaggaccccgagggcctggtgatccacaccaccagaaagagctgcacctactacatcaagatcagaaacctgaagctgatcatgctgatcttcagcatcgtgatcctgatgcagaacgccaccatgctggtggtggccggcgagaactgctggaccaacaccgagatcaaggccgactgcgtgggccccctgatcggccccagcgcctgcaccaacaagggcagcaagacctacaagaccgtggcccaggagctggtgaccgccagcaagatcacccagctggacgccgacaagtacgtgctgctgggcgacaccatcgagagcgccctggacgccatcaccagccagaagcactacagcgccatgcacctgctggagaccatgttcctgatgaagcactgcgactactacaaggtgtacgagcacaacagcggctacagccagaccaagtggagactgatcgccatcgccaacagcttcgacatctgcaccaacacccccacccccaacttctgcaagtgcctgagcgacagcagctgcagcaccaccaccctgaacttcgccaccagcatgaacgccacctacaccagcaaggtggagttcttcaaccacgacttcaccctgttcctggacatcttcgaggccgccttccccggcagcgccaccgccttcctgttcaagaagatcaaggagaagaacccctaccaggccttcgagatgatgggcaagatcgccaacaagtaccccaacaacaagctgctggtggtgatcctgaagtacggccagtacatggtgggcctgagccacgccagcacctaccagctgaagcaggagtgggtggccaagagcctgagcctgaccagagcccagagaaccggcctgaagatgagcatggccaacgccgagcccggccccgccaccaaggagtgcagcgacgccaagaccatcgcctgcctgacccccaagttccaggtggaggtgaacaacctgatgagctgcggcgccagccccaacttcaagatctacgtgaagaccggcgagctgtacaaggcccacgacagaaacagcgtgtggtgcctgaacgacatgcactgcctgaccccctacacccccgccaacgccgagatcatcaccaccatgaagaagatggactgctggcaggacaaccccaagcagcccaccgacgagtacgccatccccaagagaagctgccagatgaaggacagaggcctgtgcaacagcggcgccgacaagtggaagatcatcaagtgcgacaaccacaagctgttctacaccgacgccctggagagaagagaccccgccagcatcgtgggcagcaaccactgcttcagcgagaagtgccagatcgagagataccccatcaaccccaccagcctgaccaactgcgagtggctgtacagagccgtgagacccgagtacatcaagaagctgagcctgcagaccatcgaggagtacaagaaggccatcgccgacaagctgacccacaccctgcagctgtaccacttcgcccccctgctggagaacctgccccacatcaagcccacctacaagtacatcaccgcccagggcacctacaccgccgacggcatcgagggcgccagcatcaccaccagcatccccgccctgagcggcaccagcgtgggcttcaagatcaacgccaaggacggcaccgacctgctggacatcgtggtgtacatcaaggccagcgtggtgaagagcatctacaaccacatctacgacaccggccccaccatcaacatcaacagcaagcacgacgagctgtgcaccggccagtgccccaagaagatccccgccgaccccaactggctgaccttcagccaggagagaaccagcagatggggctgcgaggagttcggctgcctggccatcaacaccggctgcgtgtacggcagctgccaggacgtgatcagaaccgagaccaaggtgtacagaaaggccaacgaggagaccgtgatgctgaccgtgtgcatcacctaccccggccacaccttctgcaccgacgtgaacgcccacgagcccaagatcaccgacgagctggagctgcagttcaagaccatcgacatcaagagcctgcccaacctggtggccgtgaccaaccacaagctgtacaccggccagatcaacgacctgggcaccttcggccagatgtgcggcaacgtgcagaagaccaacaccagccacaccggcgccggcacccccaagttcgactacacctgctacagcgccagcagaaaggacatcatcatcagaagatgctacaacaacaactacgacagctgcagactgctgaaccaggagagcgacctgctgttcgacgacaaccacgagaccctggtggtgtacaacaacaagagactgaacggcgagctggccctgaagctgctgctgggcgacatccagtacaagctgtacaccgagaacatggagctggagctggaggccaagtgcgtgggctgcgtgggctgcttcgagagctaccagtgcaacctgcagatcaccagcagcctggacgagaccgccctgtacctggtgcccgtgagccacttccacgacagaatccagatcaagaccaccaagaaggactacgccatgaagatcagctgcaccagagaccccggcgacaaggccagcttcagagtgtgcggcaagagctacgacttcaacttccacaccgtgcccaagaacgacaagatcgaggtgaacgtgggcgacgagaccagctacatcaaggagaaggacaacagatgcggcagatggctgtgcagagtgagagacgagggcctgagcgtgatcttcgagcccctgaacaacttcttcggcaactacctgaacatgttcctgtacatcctgggcggcatcatcctgctgttcctggccctgtacatcctgatgcccatgtgcgccagactgagagacgagctgaagagaaacgagagactgcaccagatggagatgaagaagagatga

SEQ ID NO: 9271 - RNA, 4260 nt, synthetic construct
  misc_feature 1..4260: note = derived and/or modified CDS sequence (opt4) from IACOV(BeAn314206)__JN572066.1__GP
  source 1..4260: mol_type = other RNA
atgagagtgatcgccctgttccacctggtgatggtgatcaccgccaaccccgtgttccacagatgcttccagggcggccagctgatcctggagaagaagagccacgtgagcatgagcgagttctgcctgaaggacgacgtgagcatggtgaagagcgtggtggagtacgagaagaccaacaacagcatcgtgggcaccaacaaggtgtacagacagtgggtggtgagcgactggaagctgtgccaccccatcaaggccgagggcggcggcatcaacatcatcgaggtggagaaggacctgaccatcaagagcaacacctacatctgcaccaccgactgcaccatcaccgtggacaaggagaacgcccagatcatcttccagaccagcaagctgaaccacttcgaggtgaccggcaccaccctgagcaccggctggttcaagaccaaggccgccgtgaccctggaccagacctgcgagcacatcagagtgagctgcggcaagaagagcatccagttccacgcctgcttcagacagcacatgacctgcgtgagattcctgcacagaagcctgctgcccggcagcatggccaacagcatctgccagaacgtggagctgatcatcatcatcgtgctgaccctgctgatcttcatcgtgctgaacatcatcgccaagacctacatctgctacctgatgctgcccatcttcatgcccatcgcctacatctacggctggatctacaacagaagctgcaagaagtgcgtgaactgcggcctggcctaccaccccttcagcaactgcggcagccactgcgtgtgcggcgccatcttccagaccagcgacagaatgagaatgcacagagagagcggcctgtgcagcggcttcaagagcctgagagtggccagagtgctgtgcaagagcaagagcagcagcctggtgatcgccatcctgagcagcctgctgatcctgagcttcgtgacccccatcgagggcctggacctggaggagaagaagtacagcctgagcgacctgcccgacatctacaccaaggagctgaacaccctgagcgagaagatcgccatcaacttctacatcagcatcaccaacatgctgatcaccatcatcctgctgatcgtggccttctgcagccactgcatcaccaacaagatcgtgaagtacaaggccttcctgtgcaccgagtgcgacatgtaccacacctacaagaacatcagatacaacggcgacttctgcaacaagtgcggcagctgcacctgcggcaccatggaggaccccaactacaccaccatgcacaaggtgagcgacctgtgcctggccgagcccaagagaatcatccagaagaagctgatgatcatcctgatcatcttcgtgatcatcgagaacggcgcctgcctggccagcgccgaggagaagtgcttcaaggagcacgactacaacatcgagtgcatcggccccctgatcaccatgagaccctgcaccaagaagaccatccaggaggtggccagaaccctggtgaccgacaagcagatcgcccaggaggacaccgagaagatcgagctgctgcccgacagcatcgtgcaggcctggaacatgatcgacaaccagctgaactacgaccagatgttcctgatggagtacgccttcctgaagagagagtgcagcttcttcgaggagttcgagcacaacagcggcgtgaaccagatcatgtggagaaccatcgccaagaccggccacttcgacatctgcgccatcagaagcagccagagattctgcaagtgcatgagcgagagcgtgtactgcaaggacgccaactgggacatcgccaacgagatgaacgacacctacagcttcaagcccctgttctacagacacgacgtgaagctgtacagcaagatcttcaaggccgccttccagggcaccaccctgaagacctacgagaagttcctgaacgccaagaacaagaccgagctgatcaacatgctgaagaagctgggcaagagattcccctacaacaacctgctgatgggcttcctgaagttcggcgagctgctgttcgacctgaccctgttcgacgccctgcccaaggacaagaccagcagaaccagcagcaccaccgccaagagagagtacgagaacctgcaggacgccaaggtgggcgagcccaccagcgagtgcaaggacatgaagctgctgcagtgcatcagccccagataccaggtgagcgtgggcagcgtgatcaagtgcggcgacaccgagaagaagatctacgacttccacacccccgtgtacaagctggccaccgacgagaccaagtggtgcagattcgacaagcactgcctgcacgagtgggtgcccatcgacaacgccagactggagatgctgaagaagctgaactgctggtacaccgaccccaccgagatggtggacatctacaccaccagcagaaagagctgcagaatgatcaacaagggcacctgcaacatcaagaacgcccccatgaccgtgatgcagtgcgacgacgacctgatcttctacaccgaccacagaagcagcgccgacacccagggcgacatcggcgagtactgcctgagccagaactgcgacgtgagcagataccccatcaacgtgatggacggcatgacctgcacctgggagtacaacaccgtgaagcccaagtacctgagcaagaccgagctgaagaccctggaggagtacaagagaaccctgcaggacaagctgagccacaacctggaggtgtaccacttccacatgaccgccaacttcccccacatcaagcccgtgtacaagtacatcaccgccggcggcgtggagaccagcgacggcatcgagggcgccttcatcctggtggacctgcccgccctgagcggcaccagcgtgggcctgaccgtgctgagcaaggacgacgtgcccctgatggacgtgatcatctacatcaagagcgccgtgatcaaggccacctacaaccacatctacgacaccggccccaccatcggcatcaacgtgaagcacgaggagctgtgcaccggcccctgcccccagaacatcccccaccaggagcagtggctgaccttcagccaggagagaaccagcagatggggctgcgaggagttcggctgcctggccgtgggcgagggctgcgtgtacggcagctgccaggacatcatcaagaaggagaccagagtgtacaagaaggtgagcgaggagatcaacgagatcaccttctgcatcatcttccagaccaacacctactgccagaccatgaacgccatcgagccccagatcacccccagcctggaggtgcagctggagggcctggacaccaagatcctgcccaacatcctggccctgcagaaccacaagctgtacagcggccagatcaacgacctgggcagcttcggcctggcctgcggcaacgtgcagcaggtgaacaagaccatctacggcgccggccagcccaagttcgactacctgtgccacggcgccaagagaaaggacatcatcgtgagaaagtgctacaacaacaacttcggcagctgcaagctgctgaccatcgaggacaacctgatcgtggaggacaactacaacaccatcaacgtgatcaacaccaagcacctgatcggcaccgtgaagagcaagctgaacctgggcgacatcagatacaagctgttcaacaagaagcccgagttcgagctggaggcccactgcgtgggctgcgtgggctgcttcgccaactacaactgcgagatcaagatcgagagcaccatcgacatgacctgccccatcagcggcccctgcgagttcttccacaacaacatcttcatccaggccgagcacaccaagtacgccatgaagatgatctgcaagaagcagcccgaccagaccaccgagttcaccatctgcgacaagaagtaccacttcatcatcgacaccgtggagaagcacgaccagatcgagatcgacgtgggcgaccagaccagctacatcctggagaaggacaacagatgcggcacctggatgtgcaaggtgctggacgagggcctgagcgtgatcttcgagcccctgaagctgctgctgggcaactacttccacatggccatcgtgatcatcatcggcctgatcgccctggccgtgatcatctacatcctgctgcccatgttcatgaagctgagagacaccctgaaggccaacgagatcgcctaccagaaggagatgaagatcaagtga

SEQ ID NO: 9272 - RNA, 4305 nt, synthetic construct
  misc_feature 1..4305: note = derived and/or modified CDS sequence (opt4) from ILEV(KO/2)__AY859372.1__GP
  source 1..4305: mol_type = other RNA
atgctgttccccatcatcctgctgatgatccagctggtgagcagcacccccctgagcaccagatgcttccacgagggcaccctggtgaaggagaagatcagcaccaccagcatcagcgagttctgcctgaaggacgacgtgagcatgatcaagagcgagatcacctaccagaagaacgacaccggcgtgtacggccacagcaagatctacagaaactggatcgtgaaggagtggaaggcctgcaaccccgtgcccagcgccggcggcagcatcaacgtgatcgaggtgaacgaggacatgagcctggccaccaagaactacatctgcaccagagactgcgtgatcaccgtggacaaggaggacgcccagatcgtgttccagaccgacaacctgaaccacttcgaggtgagcggcaccaccctgagcagcggctggttcaagaccaaggccagcgtgaccctggacagaacctgcgagcacatcaaggtgagctgcggcaagaagaccgtgcagttccacgcctgcttcagaaaccacatgagctgcgtgagattcttccacaacaccatcctgcccggctacatggccaccagcatctgccagaacatcgagctgatcatcatcatcgtgctgaccatcgccatcttcatcatgctggtgatcctgaccaagacctacatctgctacctgctgatgcccctgttcatgcccatcgcctactgctacggctgggcctacaacaagagctgcaagaagtgcaactgctgcggcctggcctaccaccccttcaccaactgcggcagcttctgcgtgtgcggcctgaagttcgaggccagcgacagaatgagaatccacagagagagcggcctgtgccagggctacaagagcctgagagtggccagaagactgtgcaagagcaagggcagcagcttcgtgatcagcatcctgctgagcctgttcatcctgagcttcgtgacccccatcgagggcaccatgaccaactaccccgaggagagaaagtacaccctggaggagatcgccgacgtgatcgagggcttctaccaggaggccaagatcaaggagtacatcgtgttctacagcagcatcttcggcagcttcatcctgatcagcagcatgctgatcctgtacaagctgcagaacatcacctacttcctgagcaagttcaacgtgatgtactgcagcgagtgcagcatgtaccacagcaagaagaacatcaagtacctgggcgacttcaccaacaagtgcggcttctgcacctgcggcgagctggaggacgccgagggcctgagcatccacaaggtgaccaagagatgcacctacgcctaccagatgacctggaccaagatcatcctggccaccctgctgatcctgctgatcggccagaacaccctgctggtggtgagcgcccaggccgactgctgggagaagaccgagatcaccatcgactgcatcggccccatcttcgcccccaacacctgcatcaagcaggaggagaagacctacgccaaggaggcccagaccctggtggaccagaacaagatcagccaggccgacgccaagcaggtggacatgctgggcgccaccatcgacgacgccatcaaggccatcagaagccagaagacctacaccaccatgcacatgctggaggccatcttcctgagcaagtactgcgactactacagcctgttcgagcacaacagcggctacagccagggcaagtggagactgatcgccaagaccgagagcttcgacatctgcagcagacacaccacccaccacttctgcagatgcatgagcgacgagaccaagtgcaagaacggcgactgggacttcgccggcgagatgaacagcacctaccacagcaagagcaacttcctgctgcacgacctgagactgttctacaagatctacagcgccgccttccccggcctgagcgaggccatgctgtacaagttcctgagcgagaaggacaccaccaacgccatcaagctgctggagaagctgttcaccaagtacagctacaacaacctgctggtgggcatcctgagattcggcaagttcctgttcagcatgagcatcttcaacaccaccgagctgggcggcgcccagaaggccatgatcctgagacccaccgacgagctgagaaccacctacagcggcaagcaggagagcctgagcaacagcgtggtgggcgagcagaccagcgactgcgtgaacatgaagaagatcagctgcatcagccccagattcaacatccccctgagcagcatgatcgcctgcggcaaccagcccaactaccagatctacaaggagcccagcaagtactacaagagcaacaacaagcccaacacctggtgcaacaaggacatccactgcctgaacgacttcgagagcatcgaccagagcgccctggacagactgaagaccatgacctgcttcctgatcgaccccatcaccaccgaggacgtgtacagcatcgccatccacagctgcaaggtgaaggacaagggccagtgcaccatcagagacaagaagtggaacatcatcaagtgcgacagcgagctgctgtactacaccgaccacagagagggcgaggacaccggcaacgagatcggccactactgcctgagccacaagtgcggcaccgacagataccccatcaaccccgagatcatcaaggactgcatctgggagttcagaagcagaaagagcgagtacatcaacagagtggacctggagagcctggaggagttcaagagagccctgagcgacaagctgacccacaccctgaccatctacaacttcaagcccaccgccaacctgccccacatcaagcccatctacaagtacatcaccgccctgggcgtggagaacagcgacggcctggaggccgcctacatcctgaccagcatccccgccctgggcggcaccagcatcggctacaacatcatgaccaaggacaacttccccgtgatggacgtgatcatctacgtgaagagcgccgtgatccagaccacctacaaccacatctacgacaccggccccaccatcggcatcaacagcaagcacgacgagaagtgcaccggcagctgcccccagaacatcacccacgaccagaactggctgaccttcagccaggagagagccagcagatggggctgcgaggagttcggctgcctggccatcaacaccggctgcgtgttcggcagctgccaggacatgatcagaagcgacaccaaggtgtacaagaaggccctggaggagaccgtggtgctgaccgtgtgcatcaactaccccggcaacaccttctgcaccgaggtgaacagcgtggagaccaagatgaccgacgacgtggagctgcagttcaagaccgtggacaccaagaccctgcccaacctgctggccgtgaccaaccacaagctgtacagcggccagatcaacgacctgggcagcttcagccagatgtgcggcaacgtgcagaagaccaacagcaccgtgatgggcgccggcaccgtgaagttcgactacatctgccacggcgccagcagaaaggacatcatcatcagaagatgctacatgaacaactacgccagctgcagcctgctgaaggaggagaaggacctgatcttcgccgacaaccacgagaccatcaccgtgagcaacagcaagcacctggtgggcgagctgcagatcaagctgatgctgggcgacatcagatacaagctgttcgccgagagacccgagctggaggtggacgccaagtgcgtgggctgccccagctgcttcgagagctacagctgcaacttccagatcgtgaccaacatcgacaccgtgtgcaccctggagggcccctgcaccatcttccacaacagaatcatcatcagcagcaccaagcagagctacggcatcaagatgagctgccccaccaagcccaaccacatcgagaagttcaagatctgcaaccacgagtacgacatcctgttcgacaccgtggccaagaacgacaagatcgagatcgacaccggcgaccagaccctgttcgtgagagagaaggacaccagatgcaagacctggctgtgcagagtgaaggacgagggcatcagcgtgatcttcgagcccctgagagccttcttcggcagctacttcagcatcatcttctacatcatcctggccgccatcctgatcttcgtgggcgtgtacatcttcctgcccatgttcatgagactgagagacgtgctgaagagaaacgagcacctgtacctgcaggagatcaagcacaagtga

SEQ ID NO: 9273 - RNA, 4305 nt, synthetic construct
  misc_feature 1..4305: note = derived and/or modified CDS sequence (opt4) from ILEV(R5964)__KF234074.1__GP
  source 1..4305: mol_type = other RNA
atgctgttccccatcatcctgctgatgatccagctggtgagcagcacccccctgagcaccagatgcttccacgagggcaccctggtgaaggagaagatcagcaccaccagcatcagcgagttctgcctgaaggacgacgtgagcatgatcaagagcgagatcacctaccagaagaacgacaccggcgtgtacggccacagcaagatctacagaaactggatcgtgaaggagtggaaggcctgcaaccccgtgcccagcgccggcggcagcatcaacgtgatcgaggtgaacgaggacatgagcctggccaccaagaactacatctgcaccagagactgcgtgatcaccgtggacaaggaggacgcccagatcatcttccagaccgacaacctgaaccacttcgaggtgagcggcaccaccctgagcagcggctggttcaagaccaaggccagcgtgaccctggacagaacctgcgagcacatcaaggtgagctgcggcaagaagaccgtgcagttccacgcctgcttcagaaaccacatgagctgcgtgagattcttccacaacaccatcctgcccggctacatggccaccagcatctgccagaacatcgagctgatcatcatcatcgtgctgaccatcgccatcttcatcatgctggtgatcctgaccaagacctacatctgctacctgctgatgcccctgttcatgcccatcgcctactgctacggctgggcctacaacaagagctgcaagaagtgcaactgctgcggcctggcctaccaccccttcaccaactgcggcagcttctgcgtgtgcggcctgaagttcgaggccagcgacagaatgagaatccacagagagagcggcctgtgccagggctacaagagcctgagagtggccagaagactgtgcaagagcaagggcagcagcttcgtgatcagcatcctgctgagcctgttcatcctgagcttcgtgacccccatcgagggcaccatgaccaactaccccgaggagagaaagtacaccctggaggagatcgccgacgtgatcgagggcttctaccaggaggccaagatcaaggagtacatcgtgttctacagcagcatcttcggcagcttcatcctgatcagcagcatgctgatcctgtacaagctgcagaacatcacctacttcctgagcaagttcaacgtgatgtactgcagcgagtgcagcatgtaccacagcaagaagaacatcaagtacctgggcgacttcaccaacaagtgcggcttctgcacctgcggcgagctggaggacgccgagggcctgagcatccacaaggtgaccaagagatgcacctacgcctaccagatgacctggaccaagatcatcctggccaccctgctgatcctgctgatcggccagaacaccctgctggtggtgagcgcccaggccgactgctgggagaagaccgagatcaccatcgactgcatcggccccatcttcgcccccaacacctgcatcaagcaggaggagaagacctacgccaaggaggcccagaccctggtggaccagaacaagatcagccaggccgacgccgagcaggtggacatgctgggcgccaccatcgacgacgccatcaaggccatcagaagccagaagacctacaccaccatgcacatgctggaggccatcttcctgagcaagtactgcgactactacagcctgttcgagcacaacagcggctacagccagggcaagtggagactgatcgccaagaccgagagcttcgacatctgcagcagacacaccacccaccacttctgcagatgcatgagcgacgagaccaagtgcaagaacggcgactgggacttcgccggcgagatgaacagcacctaccacagcaagagcaacttcctgctgcacgacctgagactgttctacaagatctacagcgccgccttccccggcctgagcgaggccatgctgtacaagttcctgagcgagaaggacaccaccaacgccatcaagctgctggagaagctgttcaccaagtacagctacaacaacctgctggtgggcatcctgagattcggcaagttcctgttcagcatgagcatcttcaacaccaccgagctgggcggcgcccagaaggccatgatcctgagacccaccgacgagctgagaaccacctacagcggcaagcaggagagcctgagcaacagcgtggtgggcgagcagaccagcgactgcgtgaacatgaagaagatcagctgcatcagccccagattcaacatccccctgagcagcatgatcgcctgcggcaaccagcccaactaccagatctacaaggagcccagcaagtactacaagagcaacaacaagcccaacacctggtgcaacaaggacatccactgcctgaacgacttcgagagcatcgaccagagcgccctggacagactgaagaccatgacctgcttcctgatcgaccccatcaccaccgaggacgtgtacagcatcgccatccacagctgcaaggtgaaggacaagggccagtgcaccatcagagacaagaagtggaacatcatcaagtgcgacagcgagctgctgtactacaccgaccacagagagggcgaggacaccggcaacgagatcggccactactgcctgagccacaagtgcggcaccgacagataccccatcaaccccgagatcatcaaggactgcatctgggagttcagaagcagaaagagcgagtacatcaacagagtggacctggagagcctggaggagttcaagagagccctgagcgacaagctgacccacaccctgaccatctacaacttcaagcccaccgccaacctgccccacatcaagcccatctacaagtacatcaccgccctgggcgtggagaacagcgacggcctggaggccgcctacatcctgaccagcatccccgccctgggcggcaccagcatcggctacaacatcatgaccaaggacaacttccccgtgatggacgtgatcatctacgtgaagagcgccgtgatccagaccacctacaaccacatctacgacaccggccccaccatcggcatcaacagcaagcacgacgagaagtgcaccggcagctgcccccagaacatcacccacgaccagaactggctgaccttcagccaggagagaaccagcagatggggctgcgaggagttcggctgcctggccatcaacaccggctgcgtgttcggcagctgccaggacatgatcagaagcgacaccaaggtgtacaagaaggccctggaggagaccgtggtgctgaccgtgtgcatcaactaccccggcaacaccttctgcaccgaggtgaacagcgtggagaccaagatgaccgacgacgtggagctgcagttcaagaccgtggacaccaagaccctgcccaacctgctggccgtgaccaaccacaagctgtacagcggccagatcaacgacctgggcagcttcagccagatgtgcggcaacgtgcagaagaccaacagcaccgtgatgggcgccggcaccgtgaagttcgactacatctgccacggcgccagcagaaaggacatcatcatcagaagatgctacatgaacaactacgccagctgcagcctgctgaaggaggagaaggacctgatcttcgccgacaaccacgagaccatcaccgtgagcaacagcaagcacctggtgggcgagctgcagatcaagctgatgctgggcgacatcagatacaagctgttcgccgagagacccgagctggaggtggacgccaagtgcgtgggctgccccagctgcttcgagagctacagctgcaacttccagatcgtgaccaacatcgacaccgtgtgcaccctggagggcccctgcaccatcttccacaacagaatcatcatcagcagcaccaagcagagctacggcatcaagatgagctgccccaccaagcccaaccacatcgagaagttcaagatctgcaaccacgagtacgacatcctgttcgacaccgtggccaagaacgacaagatcgagatcgacaccggcgaccagaccctgttcgtgagagagaaggacaccagatgcaagacctggctgtgcagagtgaaggacgagggcatcagcgtgatcttcgagcccctgagagccttcttcggcagctacttcagcatcatcttctacatcatcctggccgccatcctgatcttcgtgggcgtgtacatcttcctgcccatgttcatgagactgagagacgtgctgaagagaaacgagcacctgtacctgcaggagatcaagcacaagtga

SEQ ID NO: 9274 - RNA, 4305 nt, synthetic construct
  misc_feature 1..4305: note = derived and/or modified CDS sequence (opt4) from MAGV__AY286443.1__GP
  source 1..4305: mol_type = other RNA
atggagctgctgatcatcatcctgctgctgggcagcgccgccagcagccccatcagcaccagatgcttccacggcggccagctgatcgccgagagcaagagcgccaccagcatcagcgagttctgcctgaaggacgacgtgagcatgatcaagagcgaggtgacctacatcaagaacgacaccggcatctacggccacaacaaggtgttcagaagctggaccatcaaggactggaagctgtgcaaccccatccccaccgccggcggcagcatcaacgtgatcgaggtgaacagcgacctgagcctggccaccagagcctacgtgtgcagcagagactgcaccatcaccatcgacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagagcctgcagttccacgcctgcttcaagcaccacatgagctgcatcagattcttccaccacaccatcctgcccggcaccatggtgagcagcatgtgccagaacatcgagctgatcatcatcatcggcctgaccctggtgatcttcatcctgatggtgatcctgaccaagacctacatctgctacctgctgatgcccgtgttcatgcccgtggcctacatctacggctgggcctacaacaagagctgcaagaagtgcaactgctgcggcctggcctaccaccccttcaccaactgcggcagccactgcgtgtgcggcctgaagttcgaggccagcgacagaatgagactgcacagagagagcggcctgtgccagggctacaagagcctgagaatcgccagaatgctgtgcaagagcaagggcagcagcctggtgatcagcggcctgctgagcatgctgctgctgagcttcatcacccccatcgagggcaccctgaccaactaccccaacgagaagcagtacaccctggaggagatcgccgacgtggtggagggcatcatcaccgagcagcacctgaaggagtacgtggtgttctacaccagcctgttcggcggcctgatcctgctgctgaccctgatcctgagcatcaccatcaacaaggtgaccgacctgctggccagcaccaacgtgatctactgcgaggagtgcagcatgtaccacagcaagaagggcatcaagtacaacggcgacttcaccaacaagtgcggcttctgcacctgcagcgagcaggaggacgtggagggcgtgatcatccacaaggtgagcagaaagtgcacctacaagtaccagctgaagtgggtgagagtgatcatgatcatcctggccctgctgctgaccatccagaacaccgtgctgatcgtggccgccgaggtggactgctggaccaagaagagcatcgagatcgactgcatcggccccctgctgaacatcggcagctgcaccgacaagagcagcagaacctacgagaccgaggtgaacaagctggtgagacagagcaaggtgacccacgccgacgccgagcagatcagcatcctgggcagcaccctggacaacgccatcaaggccgtgagaagccagaagacctacgagaccatgcacttcctggagaccgtgttcctgatgaagaactgcgactactacaacagcttcgagcacaacagcggctacagccagaccaagtggagactgatcgccaagaccagccacttcgacatctgcagcagacacagcacccaccacttctgcagatgcgtgaacgagggcaccaagtgccagaacggcgactgggacttcgccggcgagatgaacgacacctacaacagcaagaacgacttctacctgcacgacctggacctgttctacaccctgctggagaacgccttccccggcaccaccgagagcctgttctaccagctgctgcagaagaagaacaccaccggcgccagcaagctgctgggcaagctgatcaccaagtacggcaacaacaacatgttcgtggagatctggaagttcggccagtacctgctgaagctgccctacatcaacgacaccgagctgagcaccgacagaaagagcaccatcatcaagagccagcaggtgctgagcagaagccagaccggcagacaggagagcctgagcagcgccacccccggcaccgccaccaaggagtgcagcaacgccaaggacatcggctgcatcagccccagattcggcatccccatcggcaacctgaccgcctgcggcgacagccccaactacaaggtgtacaagacccccgagaagatctacaagagcaacaacagaggcgaggtgtggtgcagcgacgacgtgcactgcctgaccgacttcgagcccgccgaggaggaggtggtgaacagaatcaagcagatgacctgcttcctgaccgacgtgaccaccaagaccgacgtgttcagcgtggccatcagcacctgcaagatggtggacaagggcgtgtgcaccgtgaacgacgccaagtggaacatcctgaagtgcaacagcggcctgtactacttcaccgaccacagaggcggccaggacaccggcaacgacttcggcgagtactgcatcagccacagctgcaacaccgagagattccccatcaaccccgacgtgctgaaggactgcatctgggagtaccacagcagaaagagcaagtacatcagcaccgtgagcctggagagcctggacgagttcagaagagccatgagcgacaagctgagccacaccctgatgatctacaacttcaagcccaccgccaacctgccccacatcaagcccacctacaagttcatcaccgccaacggcatcgagaacagcgacggcatcgacagcgcctacatcctgagcagcatccccgccctgggcggcatgagcgtgggctacaacatccagaccaaggacaacttccccctgctggacatcatcgtgttcatcaagagcgccatcatcaagaccacctacaaccacatctacgacaccggccccaccatcggcatcaacacccagcacgacgagcactgcaccggcccctgccccaccctgatcccccacaaggagaactggctgaccttcagccaggagagaaccagcagatggggctgcgaggagttcggctgcctggccatcaacaccggctgcgtgttcggcagctgccaggacatcatccaccccgaggccaaggtgtacagaaaggccatcgaggaggaggtggtgctgaccgtgtgcatcaccttccccggcaacacctactgcaccgagatcaacgccatcgagcccaagatcaccgacgagatcgagctgcagttcaagaccgtggacaccaagaccctgcccaacctgctgatggtgcagaaccacaagctgtacagcggccagatcaacgacctgggcagcttcagccagggctgcggcaacgtgcagaagaccaaccagagcgtgatcggcgccggcaccgccaagttcgactacgtgtgccacggcgccagcagaaaggacgtgatcgtgagaagatgctacaacaacaactacgagagctgcaagctgctgaaggaggagaccagcctgatcttcgccgacaaccacgagaccctggaggtggccaacaccaagcacctgatcggcgagctgcagttcaagatcatgctgggcgacatcagatacaagagcttcgccgagagccccgagctggaggtggacgccaagtgcgtgggctgccccagctgcttcgagagctacagctgcaacttccagatcgtgaccaacatcgacaccgtgtgcagcgtggacggcccctgcaccctgttccacaacagactgatcatcagcgccaccaagcagagctacggcttcaagatgagctgccccagaaagcccgagcccaccgaggagttccagatctgcaacagaaagtacaacgtgctgttcaccaccatcgacaagaacgacaagatcgagatcaacaccggcgaccagaccagctacatctacgagaaggacaacagatgcaagacctggctgtgcagagtgagagacgagggcatcagcgtgatcttcgagcccctgaaggccttcttcggcagctacttcagcatcatcttctacgtggtggtgggcatcatcgtgctgttcctgaccatctacatcttcctgcccatgttcttcaagctgagagacatcctgaagagaaacgagtacctgtacctgcaggagctgaagcacaagtga

SEQ ID NO: 9275 - RNA, 4305 nt, synthetic construct
  misc_feature 1..4305: note = derived and/or modified CDS sequence (opt4) from MAGV(ts8)__AY286444.1__GP
  source 1..4305: mol_type = other RNA
atggagctgctgatcatcatcctgctgctgggcagcgccgccagcagccccatcagcaccagatgcttccacggcggccagctgatcgccgagagcaagagcgccaccagcatcagcgagttctgcctgaaggacgacgtgagcatgatcaagagcgaggtgacctacatcaagaacgacaccggcatctacggccacaacaaggtgttcagaagctggaccatcaaggactggaagctgtgcaaccccatccccaccgccggcggcagcatcaacgtgatcgaggtgaacagcgacctgagcctggccaccagagcctacgtgtgcagcagagactgcaccatcaccatcgacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagagcctgcagttccacgcctgcttcaagcaccacatgagctgcatcagattcttccaccacaccatcctgcccggcaccatggtgagcagcatgtgccagaacatcgagctgatcatcatcatcggcctgaccctggtgatcttcatcctgatggtgatcctgaccaagacctacatctgctacctgctgatgcccgtgttcatgcccgtggcctacatctacggctgggcctacaacaagagctgcaagaagtgcaactgctgcggcctggcctaccaccccttcaccaactgcggcagccactgcgtgtgcggcctgaagttcgaggccagcgacagaatgagactgcacagagagagcggcctgtgccagggctacaagagcctgagaatcgccagaatgctgtgcaagagcaagggcagcagcctggtgatcagcggcctgctgagcatgctgctgctgagcttcatcacccccatcgagggcaccctgaccaactaccccaacgagaagcagtacaccctggaggagatcgccgacgtggtggagggcatcatcaccgagcagcacctgaaggagtacgtggtgttctacaccagcctgttcggcggcctgatcctgctgctgaccctgatcctgagcatcaccatcaacaaggtgaccgacctgctggccagcaccaacgtgatctactgcgaggagtgcagcatgtaccacagcaagaagggcatcaagtacaacggcgacttcaccaacaagtgcggcttctgcacctgcagcgagcaggaggacgtggagggcgtgatcatccacaaggtgagcagaaagtgcacctacaagtaccagctgaagtgggtgagagtgatcatgatcatcctggccctgctgctgaccatccagaacaccgtgctgatcgtggccgccgaggtggactgctggaccaagaagagcatcgagatcgactgcatcggccccctgctgaacatcggcagctgcaccgacaagagcagcagaacctacgagaccgaggtgaacaagctggtgagacagagcaaggtgacccacgccgacgccgagcagatcagcatcctgggcagcaccctggacaacgccatcaaggccgtgagaagccagaagacctacgagaccatgcacttcctggagaccgtgttcctgatgaagaactgcgactactacaacagcttcgagcacaacagcggctacagccagaccaagtggagactgatcgccaagaccagccacttcgacatctgcagcagacacagcacccaccacttctgcagatgcgtgaacgagggcaccaagtgccagaacggcgactgggacttcgccggcgagatgaacgacacctacaacagcaagaacgacttctacctgcacgacctggacctgttctacaccctgctggagaacgccttccccggcaccaccgagagcctgttctaccagctgctgcagaagaagaacaccaccggcgccagcaagctgctgggcaagctgatcaccaagtacggcaacaacaacatgttcgtggagatctggaagttcggccagtacctgctgaagctgccctacatcaacgacaccgagctgagcaccgacagaaagagcaccatcatcaagagccagcaggtgctgagcagaagccagaccggcagacaggagagcctgagcagcgccacccccggcaccgccaccaaggagtgcagcaacgccaaggacatcggctgcatcagccccagattcggcatccccatcggcaacctgaccgcctgcggcgacagccccaactacaaggtgtacaagacccccgagaagatctacaagagcaacaacagaggcgaggtgtggtgcagcgacgacgtgcactgcctgaccgacttcgagcccgccgaggaggaggtggtgaacagaatcaagcagatgacctgcttcctgaccgacgtgaccaccaagaccgacgtgttcagcgtggccatcagcacctgcaagatggtggacaagggcgtgtgcaccgtgaacgacgccaagtggaacatcctgaagtgcaacagcggcctgtactacttcaccgaccacagagacggccaggacaccggcaacgacttcggcgagtactgcatcagccacagctgcaacaccgagagattccccatcaaccccgacgtgctgaaggactgcatctgggagtaccacagcagaaagagcaagtacatcagcaccgtgagcctggagagcctggacgagttcagaagagccatgagcgacaagctgagccacaccctgatgatctacaacttcaagcccaccgccaacctgccccacatcaagcccacctacaagttcatcaccgccaacggcatcgagaacagcgacggcatcgacagcgcctacatcctgagcagcatccccgccctgggcggcatgagcgtgggctacaacatccagaccaaggacaacttccccctgctggacatcatcgtgttcatcaagagcgccatcatcaagaccacctacaaccacatctacgacaccggccccaccatcggcatcaacacccagcacgacgagcactgcaccggcccctgccccaccctgatcctgcacaaggagaactggctgaccttcagccaggagagaaccagcagatggggctgcgaggagttcggctgcctggccatcaacaccggctgcgtgttcggcagctgccaggacatcatccaccccgaggccaaggtgtacagaaaggccatcgaggaggaggtggtgctgaccgtgtgcatcaccttccccggcaacacctactgcaccgagatcaacgccatcgagcccaagatcaccgacgagatcgagctgcagttcaagaccgtggacaccaagaccctgcccaacctgctgatggtgcagaaccacaagctgtacagcggccagatcgacgacctgggcagcttcagccagggctgcggcaacgtgcagaagaccaaccagagcgtgatcggcgccggcaccgccaagttcgactacgtgtgccacggcgccagcagaaaggacgtgatcgtgagaagatgctacaacaacaactacgagagctgcaagctgctgaaggaggagaccagcctgatcttcgccgacaaccacgagaccctggaggtggccaacaccaagcacctgatcggcgagctgcagttcaagatcatgctgggcgacatcagatacaagagcttcgccgagagccccgagctggaggtggacgccaagtgcgtgggctgccccagctgcttcgagagctacagctgcaacttccagatcgtgaccaacatcgacaccgtgtgcagcgtggacggcccctgcaccctgttccacaacagactgatcatcagcgccaccaagcagagctacggcttcaagatgagctgccccagaaagcccgagcccaccgaggagttccagatctgcaacagaaagtacaacgtgctgttcaccaccatcgacaagaacgacaagatcgagatcaacaccggcgaccagaccagctacatctacgagaaggacaacagatgcaagacctggctgtgcagagtgagagacgagggcatcagcgtgatcttcgagcccctgaaggccttcttcggcagctacttcagcatcatcttctacgtggtggtgggcatcatcgtgctgttcctgaccatctacatcttcctgcccatgttcttcaagctgagagacatcctgaagagaaacgagtacctgtacctgcaggagctgaagcacaagtga

SEQ ID NO: 9276 - RNA, 4311 nt, synthetic construct
  misc_feature 1..4311: note = derived and/or modified CDS sequence (opt4) from MAGV(AG83-1746)__KX100113.1__GP
  source 1..4311: mol_type = other RNA
atgaagatgatcctgctgatcatcatcctgtgcgtgaacctggccgccgccaaccccgtggccaccagatgcttccacggcggccagctgatcgccgagaccagaagcgccaccagcatcagcgagttctgcctgaaggacgacgtgagcatgatcaagagcgagatcacctacaccaagaacgacaccggcatcttcggccacagcaagatctacaagagctggctgatcaaggactggaagctgtgcaaccccgtgcccaccgccggcggcagcatcaacgtgatcgaggtgaacagcgacctgagcctgaccaccaaggcctacgtgtgcagcagagactgcaccatcaccatcgacaaggaggaggcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcagacaccacatgagctgcgtgagattcttccacaacaccatcctgcccggcaccatggtgaacagcatgtgccagaacatcgagctgatcatcatcctgggcctgaccctgatcatcttcaccctgatggtgatcctgaccaagacctacatctgctacatcctgatgcccctgttcatgcccatcgcctacgcctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctgatcatcagcaccctgctgagcatgctgctgctgagcttcatcacccccatcgagggcaccatgaccaactaccccgagaccagacagtacagcctggaggagatcgccgacgtggtggagggcctgctgagcgagcagaacatcaaggagtacgtggtgttctacaccagcctgttcggcagcctgatcctgctgctggccttcatcctgagcatcaccctgaccaaggtgaccaacgccctggccaagaccaacgtgatctactgcgaggagtgcagcatgtaccacgccaagaagggcatcaagtacaacggcgacttcaccaacaagtgcggcttctgcacctgcgacgagcaggaggacgaggagggcatcatcatccacaaggtgagcaagaagtgcacctacagataccagctgcagtgggccaagatcatcatgatcatcctggtgatgctgctgatgatgcagaacaccatcctgatcgtggccgccgagaccgactgctggaccaagaacagcctggagctggactgcatcggccccctgctgaccatcagcgactgcagcaacaaggagagcaagaactacgaggaggaggccgccaagctggtgagccagagcaagatcacccaggccgacgccgagcaggtgaccatcctgggcaacaccatcgacaccgccctgaaggccatcagaagccagaagacctaccagaccatgcacctgctggagagcgtgttcctgatgaagaactgcgactactacagcagcttcgagcacaacagcggctacagccaggccaagtggagactgatcgccaagaccagccacttcgacatctgcagcagacacagcatgcaccacttctgcagatgcgtggccgacggcaccaagtgccagaacggcaactgggacttcgccggcgagatgaacaacacctacagcaccaagaacgacttctacctgcacgacctgaacctgttcttcaccctgcacgagaccgccttccccggcaccaccgagagcctgttctaccagctgatcgccaagaagaacaccaccggcgccagcaagctgctgggcaagctgatcaccaagtacggcaacaacaagctgttcgtgggcatctggaagttcggccagtacctgctgaccctgccctacgtgaacaccaccgagctgagcaagaccagaaaggagaccatcctgaagccccaccagatcctgaccagaagccagggcggcagacccgagagcatgagcagcgccgaggtgggccagaccgccaaggagtgcgccaacgccaagaacgtgggctgcatcagccccagattcggcgtgcccatcggcaacctgaccgcctgcggcaacagccccaactacaagatctacaagacccccaacaagatctacaagagcaacaacagaggcgaggtgtggtgcagcgaggacgtgcactgcctggccgacttcgagcccgccgacaccgaggtggtgaacaaggtgaagaagatgacctgcttcctgagcgacgtgaacaccagagccgacatcttcagcatcgccatcagcgcctgcagaatggtggacaagggcgtgtgcaccgtgaacggcgccaagtggaacatcctgaagtgcgagagcggcctgtactacttcaccgaccacagagagggccaggacaccggcaacgacttcggcgagtactgcatcagccacagctgcaacaccgagagataccccatcaaccccgacatcctgaaggagtgcatctgggagtaccacagcagaaagagcaagtacatcagcaccatcaacctggagagcctggaggagttcaagagagccatgagcgacaagctgagccacaccctgatggtgtacaacttcaagcccaccgccaacctgccccacatcaagcccagctacaagttcatcaccgccaacggcatcgagaacagcgacggcctggagagcgcctacatcctgagcagcatccccgccatcggcggcatgagcatcggctacaacatccagaccaaggacaacttccccctgctggacctgatcgtgttcgtgaagagcgccgtgatcaagaccacctacaaccacatctacgacaccggccccaccatcggcatcaacaccaaccacgacgagcactgcaccggcccctgccccaccatcatcccccacaaggagaactggctgaccttcagccaggagagaaccagcagatggggctgcgaggagttcggctgcctggccatcaacaccggctgcgtgttcggcagctgccaggacgtgatccaccccgagaccaagatctacagaaaggccgtggaggaggaggtggtgctgaccgtgtgcatcaacttccccggcaacaccttctgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccagagcatcctgggcgccggcaccgtgaagttcgactacgtgtgccacggcgccagcagaaaggacatcatcgtgagaagatgctacaccaacaactacgacagctgcaagctgctgaaggaggagagaagcctgatcttcgccgacaaccacgagaccctggaggtggccaacaccagacacctgatcggcgagctgcagttcaagatcatgctgggcgacatcagatacaaggccttcgccgagaagcccgagctggagatcgacgccaagtgcgtgggctgccccagctgcttcgagagctacagctgcagcttccagatcgtgaccagcatcgacaccgtgtgcagcgtggagggcccctgcaccctgttccacaacagaatcatcatcaccgccgccaagcagagctacggcgtgaagatgagctgcaagaccaagcccggccccgtggaggagttcagaatctgcaacagaaactacagagtgagcttcgccaccatcgacaagaacgacaagatcgagatcaacaccggcgaccagaccagctacatcgtggagaaggacagcagatgcaagacctggctgtgcagagtgagagacgagggcatcagcgtgatcttcgagcccctgaaggccttcttcggcagctacttcagcgtggccttctacatcatcatcggcatcgccgccctgttcctgatcatctacatcttcctgcccatgttcttcaagctgagagacgtgctgaagaagaacgagtacctgtacctgcaggagctgaagcacaagtga

SEQ ID NO: 9277 - RNA, 4305 nt, synthetic construct
  misc_feature 1..4305: note = derived and/or modified CDS sequence (opt4) from MAGV(BeAr 7272)__KX100104.1__GP
  source 1..4305: mol_type = other RNA
atggagctgctgatcatcatcctgctgctgggcagcgccgccagcagccccatcagcaccagatgcttccacggcggccagctgatcgccgagagcaagagcgccaccagcatcagcgagttctgcctgaaggacgacgtgagcatgatcaagagcgaggtgacctacatcaagaacgacaccggcatctacggccacaacaaggtgttcagaagctggaccatcaaggactggaagctgtgcaaccccatccccaccgccggcggcagcatcaacgtgatcgaggtgaacagcgacctgagcctggccaccagagcctacgtgtgcagcagagactgcaccatcaccatcgacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagagcctgcagttccacgcctgcttcaagcaccacatgagctgcatcagattcttccaccacaccatcctgcccggcaccatggtgagcagcatgtgccagaacatcgagctgatcatcatcatcggcctgaccctggtgatcttcatcctgatggtgatcctgaccaagacctacatctgctacctgctgatgcccgtgttcatgcccgtggcctacatctacggctgggcctacaacaagagctgcaagaagtgcaactgctgcggcctggcctaccaccccttcaccaactgcggcagccactgcgtgtgcggcctgaagttcgaggccagcgacagaatgagactgcacagagagagcggcctgtgccagggctacaagagcctgagaatcgccagaatgctgtgcaagagcaagggcagcagcctggtgatcagcggcctgctgagcatgctgctgctgagcttcatcacccccatcgagggcaccctgaccaactaccccaacgagaagcagtacaccctggaggagatcgccgacgtggtggagggcatcatcaccgagcagcacctgaaggagtacgtggtgttctacaccagcctgttcggcggcctgatcctgctgctgaccctgatcctgagcatcaccatcaacaaggtgaccgacctgctggccagcaccaacgtgatctactgcgaggagtgcagcatgtaccacagcaagaagggcatcaagtacaacggcgacttcaccaacaagtgcggcttctgcacctgcagcgagcaggaggacgtggagggcgtgatcatccacaaggtgagcagaaagtgcacctacaagtaccagctgaagtgggtgagagtgatcatgatcatcctggccctgctgctgaccatccagaacaccgtgctgatcgtggccgccgaggtggactgctggaccaagaagagcatcgagatcgactgcatcggccccctgctgaacatcggcagctgcaccgacaagagcagcagaacctacgagaccgaggtgaacaagctggtgagacagagcaaggtgacccacgccgacgccgagcagatcagcatcctgggcagcaccctggacaacgccatcaaggccgtgagaagccagaagacctacgagaccatgcacttcctggagaccgtgttcctgatgaagaactgcgactactacaacagcttcgagcacaacagcggctacagccagaccaagtggagactgatcgccaagaccagccacttcgacatctgcagcagacacagcacccaccacttctgcagatgcgtgaacgagggcaccaagtgccagaacggcgactgggacttcgccggcgagatgaacgacacctacaacagcaagaacgacttctacctgcacgacctggacctgttctacaccctgctggagaacgccttccccggcaccaccgagagcctgttctaccagctgctgcagaagaagaacaccaccggcgccagcaagctgctgggcaagctgatcaccaagtacggcaacaacaacatgttcgtggagatctggaagttcggccagtacctgctgaagctgccctacatcaacgacaccgagctgagcaccgacagaaagagcaccatcatcaagagccagcaggtgctgagcagaagccagaccggcagacaggagagcctgagcagcgccacccccggcaccgccaccaaggagtgcagcaacgccaaggacatcggctgcatcagccccagattcggcatccccatcggcaacctgaccgcctgcggcgacagccccaactacaaggtgtacaagacccccgagaagatctacaagagcaacaacagaggcgaggtgtggtgcagcgacgacgtgcactgcctgaccgacttcgagcccgccgaggaggaggtggtgaacagaatcaagcagatgacctgcttcctgaccgacgtgaccaccaagaccgacgtgttcagcgtggccatcagcacctgcaagatggtggacaagggcgtgtgcaccgtgaacgacgccaagtggaacatcctgaagtgcaacagcggcctgtactacttcaccgaccacagagacggccaggacaccggcaacgacttcggcgagtactgcatcagccacagctgcaacaccgagagattccccatcaaccccgacgtgctgaaggactgcatctgggagtaccacagcagaaagagcaagtacatcagcaccgtgagcctggagagcctggacgagttcagaagagccatgagcgacaagctgagccacaccctgatgatctacaacttcaagcccaccgccaacctgccccacatcaagcccacctacaagttcatcaccgccaacggcatcgagaacagcgacggcatcgacagcgcctacatcctgagcagcatccccgccctgggcggcatgagcgtgggctacaacatccagaccaaggacaacttccccctgctggacatcatcgtgttcatcaagagcgccatcatcaagaccacctacaaccacatctacgacaccggccccaccatcggcatcaacacccagcacgacgagcactgcaccggcccctgccccaccctgatcccccacaaggagaactggctgaccttcagccaggagagaaccagcagatggggctgcgaggagttcggctgcctggccatcaacaccggctgcgtgttcggcagctgccaggacatcatccaccccgaggccaaggtgtacagaaaggccatcgaggaggaggtggtgctgaccgtgtgcatcaccttccccggcaacacctactgcaccgagatcaacgccatcgagcccaagatcaccgacgagatcgagctgcagttcaagaccgtggacaccaagaccctgcccaacctgctgatggtgcagaaccacaagctgtacagcggccagatcaacgacctgggcagcttcagccagggctgcggcaacgtgcagaagaccaaccagagcgtgatcggcgccggcaccgccaagttcgactacgtgtgccacggcgccagcagaaaggacgtgatcgtgagaagatgctacaacaacaactacgagagctgcaagctgctgaaggaggagaccagcctgatcttcgccgacaaccacgagaccctggaggtggccaacaccaagcacctgatcggcgagctgcagttcaagatcatgctgggcgacatcagatacaagagcttcgccgagagccccgagctggaggtggacgccaagtgcgtgggctgccccagctgcttcgagagctacagctgcaacttccagatcgtgaccaacatcgacaccgtgtgcagcgtggacggcccctgcaccctgttccacaacagactgatcatcagcgccaccaagcagagctacggcttcaagatgagctgccccagaaagcccgagcccaccgaggagttccagatctgcaacagaaagtacaacgtgctgttcaccaccatcgacaagaacgacaagatcgagatcaacaccggcgaccagaccagctacatctacgagaaggacaacagatgcaagacctggctgtgcagagtgagagacgagggcatcagcgtgatcttcgagcccctgaaggccttcttcggcagctacttcagcatcatcttctacgtggtggtgggcatcatcgtgctgttcctgaccatctacatcttcctgcccatgttcttcaagctgagagacatcctgaagagaaacgagtacctgtacctgcaggagctgaagcacaagtga

SEQ ID NO: 9278 - RNA, 4311 nt, synthetic construct
  misc_feature 1..4311: note = derived and/or modified CDS sequence (opt4) from MAGV(CbaAr 426)__KX100110.1__GP
  source 1..4311: mol_type = other RNA
atgaagatgatcctgctgatcatcatcctgtgcgtgaacctggccgccgccaaccccgtggccaccagatgcttccacggcggccagctgatcgccgagaccagaagcgccaccagcatcagcgagttctgcctgaaggacgacgtgagcatgatcaagagcgagatcacctacaccaagaacgacaccggcatcttcggccacagcaagatctacaagagctggctgatcaaggactggaagctgtgcaaccccgtgcccaccgccggcggcagcatcaacgtgatcgaggtgaacagcgacctgagcctgaccaccaaggcctacgtgtgcagcagagactgcaccatcaccatcgacaaggaggaggcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcagacaccacatgagctgcgtgagattcttccacaacaccatcctgcccggcaccatggtgaacagcatgtgccagaacatcgagctgatcatcatcctgggcctgaccctgatcatcttcaccctgatggtgatcctgaccaagacctacatctgctacatcctgatgcccctgttcatgcccatcgcctacgcctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctgatcatcagcaccctgctgagcatgctgctgctgagcttcatcacccccatcgagggcaccatgaccaactaccccgagaccagacagtacagcctggaggagatcgccgacgtggtggagggcctgctgagcgagcagaacatcaaggagtacgtggtgttctacaccagcctgttcggcagcctgatcctgctgctggccttcatcctgagcatcaccctgaccaaggtgaccaacgccctggccagaaccaacgtgatctactgcgaggagtgcagcatgtaccacgccaagaagggcatcaagtacaacggcgacttcaccaacaagtgcggcttctgcacctgcgacgagcaggaggacgaggagggcatcatcatccacaaggtgagcaagaagtgcacctacagataccagctgcagtgggccaagatcatcatgatcatcctggtgatgctgctgatgatgcagaacaccatcctgatcgtggccgccgagaccgactgctggaccaagaacagcctggagctggactgcatcggccccctgctgaccatcagcgactgcagcaacaaggagagcaagaactacgaggaggaggccgccaagctggtgagccagagcaagatcacccaggccgacgccgagcaggtgaccatcctgggcaacaccatcgacaccgccctgaaggccatcagaagccagaagacctaccagaccatgcacctgctggagagcgtgttcctgatgaagaactgcgactactacagcagcttcgagcacaacagcggctacagccaggccaagtggagactgatcgccaagaccagccacttcgacatctgcagcagacacagcatgcaccacttctgcagatgcgtggccgacggcaccaagtgccagaacggcgactgggacttcgccggcgagatgaacaacacctacagcaccaagaacgacttctacctgcacgacctgaacctgttcttcaccctgcacgagaccgccttccccggcaccaccgagagcctgttctaccagctgatcgccaagaagaacaccaccggcgccagcaagctgctgggcaagctgatcaccaagtacggcaacagcaagctgttcgtgggcatctggaagttcggccagtacctgctgaccctgccctacgtgaacaccaccgagctgagcaagaccagaagagagaccatcctgaagacccaccagatcctgaccagaagccagggcggcagaagcgagagcatgagcagcgccgaggtgggccagatcgccaaggagtgcgccaacgccaagaacgtgggctgcatcagccccagattcggcatccccatcggcaacctgaccgcctgcggcaacagccccaactacaagatctacaagacccccaacaagatctacaagagcaacaacagaggcgaggtgtggtgcagcgaggacgtgcactgcctggccgacttcgagcccgccgacaccgaggtggtgaacaaggtgaagaagatgacctgcttcctgagcgacgtgaacaccagagccgacatcttcagcatcgccatcagcgcctgcagaatggtggacaagggcgtgtgcaccgtgaacggcgccaagtggaacatcctgaagtgcgagagcggcctgtactacttcaccgaccacagagagggccaggacaccggcaacgacttcggcgagtactgcatcagccacagctgcaacaccgagagataccccatcaaccccgacatcctgaaggagtgcatctgggagtaccacagcagaaagagcaagtacatcagcaccatcaacctggagagcctggaggagttcaagagagccatgagcgacaagctgagccacaccctgatggtgtacaacttcaagcccaccgccaacctgccccacatcaagcccagctacaagttcatcaccgccaacggcatcgagaacagcgacggcctggagagcgcctacatcctgagcagcatccccgccatcggcggcatgagcatcggctacaacatccagaccaaggacaacttccccctgctggacctgatcgtgttcgtgaagagcgccgtgatcaagaccacctacaaccacatctacgacaccggccccaccatcggcatcaacaccaaccacgacgagcactgcaccggcccctgccccaccatcatcccccacaaggagaactggctgaccttcagccaggagagaaccagcagatggggctgcgaggagttcggctgcctggccatcaacaccggctgcgtgttcggcagctgccaggacgtgatccaccccgagaccaagatctacagaaaggccgtggaggaggaggtggtgctgaccgtgtgcatcaacttccccggcaacaccttctgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccagagcatcctgggcgccggcaccgtgaagttcgactacgtgtgccacggcgccagcagaaaggacatcatcgtgagaagatgctacaccaacaactacgacagctgcaagctgctgaaggaggagagaagcctgatcttcgccgacaaccacgagaccctggaggtggccaacaccagacacctgatcggcgagctgcagttcaagatcatgctgggcgacatcagatacaaggccttcgccgagaagcccgagctggagatcgacgccaagtgcgtgggctgccccagctgcttcgagagctacagctgcaacttccagatcgtgaccagcatcgacaccgtgtgcagcgtggagggcccctgcaccctgttccacaacagaatcatcatcaccgccgccaagcagagctacggcgtgaagatgagctgcaagaccaagcccggccccgtggaggagttcaccatctgcaacagaaactacagagtgagcttcgccaccatcgacaagaacgacaagatcgagatcaacaccggcgaccagaccagctacatcgtggagaaggacagcagatgcaagacctggctgtgcagagtgagagacgagggcatcagcgtgatcttcgagcccctgaaggccttcttcggcagctacttcagcatcgccttctacatcatcatcggcatcgccgccctgttcctgatcatctacatcttcctgcccatgttcttcaagctgagagacgtgctgaagaagaacgagtacctgtacctgcaggagctgaagcacaagtga

SEQ ID NO: 9279 - RNA, 4305 nt, synthetic construct
  misc_feature 1..4305: note = derived and/or modified CDS sequence (opt4) from MAGV(CoAr 3363)__KX100107.1__GP
  source 1..4305: mol_type = other RNA
atgctgagcctgctgatcctggccttcctgggcctgagcaccagcaaccccatcgccaccagatgcttccacggcggccagctgatcgccgagagcaagagcgccaccagcatcagcgagttctgcctgaaggacgacgtgagcatgctgaagagcgaggtggtgtacaccaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccagaagaaacgtgatctactgcgaggagtgcagcatgtaccacagcaagagaggcatcaagtacaacggcgacttcaccaacaagtgcggcttctgcacctgcaacgagcaggaggacgccgagggcctggtgatccacaaggtgagcaagagatgcacctacaagtgccagctgaagtgggccaaggtgctgatgatcaccctggtgctgctgctgatcgcccagaacaccatcctgatcgtggccgccaagaccgactgctggaccaagaagagcctggacatcgactgcatcggccccatgctggacatcggcagctgcaccaacaagaacaccagaagctacgacaccgaggcccagaagctggtgacccagagcaaggtgagccagctggacgccgaccaggccagcctgctgggcagcagcatcgacagcgccatcaaggccatcagaacccagaagacctaccccaccatgcacctgctggagaccatcttcctgatgaagaactgcgactactacaccagcttcaaccacaacagcggctacagccaggccagatggagactgatcgccaagaccggccacttcgacatctgcagcagacacagcacccaccacttctgcagatgcatcagcgacggcaccaagtgccagaacggcgactgggacttcgccggcgagatgaacgagccctacaacagcaagaacgacttctacctgcacgacctgaacctgttctacaccatcttcgagaacgccttccccggcaccaccgagagcctgttctaccagctgatccagaagagagacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaaagcagaccatcctggccacccaggagcccctgagcagaagccaccccggcagacaggagagcatgagcagcgccatccagggcagcgtgaccaaggagtgccacaacgccaaggacgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaaggtgaagaagctgacctgcttcctgaccgacgtgctggtgaagaccgacatcttcagcgtggccgccagcacctgcaagatggccgacaagggcatctgcaccgtgaacgacgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgagcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatcaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgccaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtgatcggcatcatcgtgctgttcctgatcgtgtacatcttcctgcccatgttcttcaagctgaaggacgtgctgaagaagaacgagtacctgtacctgcaggagctgaagcacaagtga

SEQ ID NO: 9280 - RNA, 4305 nt, synthetic construct
  misc_feature 1..4305: note = derived and/or modified CDS sequence (opt4) from MAGV(OBS 6657)__KX100116.1__GP
  source 1..4305: mol_type = other RNA
atggagctgctgatcatcatcctgctgctgggcagcgccgccagcagccccgtgagcaccagatgcttccacggcggccagctgatcgccgagagcaagagcgccaccagcatcagcgagttctgcctgaaggacgacgtgagcatgatcaagagcgaggtgacctacaccaagaacgacaccggcatctacggccacaacaaggtgttcagaagctggaccatcaaggactggaagctgtgcaaccccatccccaccgccggcggcagcatcaacgtgatcgaggtgaacagcgacctgagcctggccaccaaggcctacgtgtgcagcagagactgcaccatcaccatcgacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagagcctgcagttccacgcctgcttcaagcaccacatgagctgcatcagattcttccaccacaccatcctgcccggcaccatggtgagcagcatgtgccagaacatcgagctgatcatcatcatcggcctgaccctggtgctgttcatcctgatggtgatcctgaccaagacctacatctgctacctgctgatgcccatcttcatgcccatcgcctacatctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagaatgctgtgcaagagcaagggcagcagcctggtgatcagcggcctgctgagcatgctgctgctgagcttcatcacccccatcgagggcaccctgaccaactaccccaacgagagacagtacaccctggaggagatcgccgacgtggtggagggcatcctgaccgagcagcacctgaaggagtacgtggtgttctacaccagcctgttcggcggcctgatcctgctgctgaccctgatcctgagcatcaccatcaacaaggtgaccgacctgctggccagcaccaacgtgatctactgcgaggagtgcagcatgtaccacagcaagaagggcatcaagtacaacggcgacttcaccaacaagtgcggcttctgcacctgcagcgagcaggaggacatcgagggcgtggtgatccacaaggtgagcagaaagtgcacctacaagtaccagctgaagtgggtgagagtgatcatgatcatcctggccctgctgctgaccctgcagaacaccgtgctgatcgtggccgccgaggtggactgctggaccaagaagagcatcgagatcgactgcatcggccccctgctgaacatcggcacctgcaccgacaagagcagcagaacctacgagaccgaggtgaacaagctggtgagacagagcaaggtgacccaggccgacgccgagcaggtgagcatcctgggcagcaccctggacagcgccatcaaggccatcagaagccagaagacctacgagaccatgcacttcctggagaccgtgttcctgatgaagaactgcgactactacagcagcttcgagcacaacagcggctacagccagaccaagtggagactgatcgccaagaccagccacttcgacatctgcagcagacacagcgcccaccacttctgcagatgcgtgaacgagggcaccaagtgccagaacggcgactgggacttcgccagagagatgaacgacacctacaacagcaagaacgacttctacctgcacgacctggacctgttctacaccctgttcgagaacgccttccccggcaccaccgagagcctgttctaccagctgctgcagaagaagaacaccaccggcgccagcaagctgctgggcaagctgatcaccaagtacggcaacaacaacctgttcgtgggcatctggaagttcggccagtacctgctgaagctgccctacatcaacgacaccgagctgagcaccgacagaaagagcaccatcatgaagagccagcagatgctgagcagaagccagaccggcagacaggagagcctgagcagcgccacccccggcaccgccaccaaggagtgcagcaacgccaaggacatcggctgcatcagccccagattcggcatccccatcggcaacctgaccgcctgcggcgacagccccaactacaagatctacaagacccccgagaagatctacaagagcaacaacaagggcgaggtgtggtgcagcgacgacgtgcactgcctggccgacttcgagcccgccgaggaggaggtggtgaacagaatcaagcagatgacctgcttcctgaccgacgtgaccaccaagaccgacgtgttcagcgtggccatcagcacctgcaagatggccgacaagggcgtgtgcaccgtgaacgacgccaagtggaacatcctgaagtgcaacagcggcctgtactacttcaccgaccacagagacggccaggacaccggcaacgacttcggcgagtactgcatcagccacagctgcaacaccgagagattccccatcaaccccgacgtgctgaaggactgcatctgggagtaccacagcagaaagagcaagtacatcagcaccatcagcctggagagcctggacgagttcagaagagccatgagcgacaagctgagccacaccctgatgatctacaacttcaagcccaccgccaacctgccccacatcaagcccacctacaagttcatcaccgccaacggcatcgagaacagcgacggcatcgacagcgcctacatcctgagcagcatccccgccctgggcggcatgagcgtgggctacaacgtgcagaccaaggacaacttccccctgctggacatcatcgtgttcatcaagagcgccatcatcaagaccacctacaaccacatctacgacaccggccccaccatcggcatcaacacccagcacgacgagcactgcaccggcccctgccccaccctgatcccccacaaggagaactggctgaccttcagccaggagagaaccagcagatggggctgcgaggagttcggctgcctggccatcaacaccggctgcgtgttcggcagctgccaggacatcatccaccccgaggccaaggtgtacagaaaggccatcgaggaggaggtggtgctgaccgtgtgcatcaccttccccggcaacacctactgcaccgagatcaacgccatcgagcccaagatcaccgacgagatcgagctgcagttcaagaccgtggacaccaagaccctgcccaacctgctgatggtgcagaaccacaagctgtacagcggccagatcaacgacctgggcagcttcagccagggctgcggcaacgtgcagaagaccaaccagagcgtgatcggcaccggcaccgccaagttcgactacgtgtgccacggcgccagcagaaaggacgtgatcgtgagaagatgctacaacaacaactacgagagctgcaagctgctgaaggaggagagcagcctgatcttcgccgacaaccacgagaccctggaggtggccaacaccaagcacctgatcggcgagctgcagttcaagatcatgctgggcgacatcagatacaagagcttcgccgagagccccgagctggaggtggacgccaagtgcgtgggctgccccagctgcttcgagagctacagctgcaacttccagatcgtgaccaacatcgacaccgtgtgcagcgtggacggcccctgcaccctgttccacaacagactgatcatcagcgccgccaagcagagctacggcctgaagatgagctgcagcagaagacccgagcagaccgaggagttccagatctgcaacagaaagtacagcgtgctgttcaccaccatcgacaagaacgacaagatcgagatcaacaccggcgaccagaccagctacatctacgagaaggacaacagatgcaagacctggctgtgcagagtgagagacgagggcatcagcgtgatcttcgagcccctgaaggccttcttcggcagctacttcagcatcatcttctacgtgatcgtgggcatcatcgtgctgttcctgatcatctacatcttcctgcccatgttcttcaagctgagagacatcctgaagagaaacgagtacctgtacctgcaggagctgaagcacaagtga

SEQ ID NO: 9281 - RNA, 4302 nt, synthetic construct
  misc_feature 1..4302: note = derived and/or modified CDS sequence (opt4) from NORV(0234)__EU004188.1__GP
  source 1..4302: mol_type = other RNA
atgatctggttcatcctgctgctggccatcgcccccagcttcggcacccccatcgccaccagatgcttccacggcggccagctgatcgccgaggccaagagccagaccagcatcagcgagttctgcctgaaggacgacgtgagcatgatcaagagcgaggtgacctacaccaagaacgacaccggcatcttcggccacagcaaggtgtacagaagctggaccatcaaggactggaagctgtgcaaccccgtgcccaccgtgggcggcagcatcaacgtgatcgaggtgaccgccgacctgagcctgagcaccaaggcctacgtgtgcagcagagactgcaccatcaccatcgacaaggagggcgcccagatcgtgttccagaccgacaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacaacaccatcctgcccggcagcatggtggccagcatgtgccagaacatcgagctgatcatcatcctgggcctgaccctgatcatcttcatcctgatggccatcctgaccaagacctacatctgctacctgctgatgcccatcttcatgcccatcgcctacgcctacggctgggcctacaacaagagctgcaagaagtgccactgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctggtgatcagcatcctgctgagcatgctgatcctgagcttcgtgacccccatcgagggcaccctgaccaactaccccgagagcagaagatacaccctggaggagatcgccgacgtggtggagggcatcatcgccgagcaggacctgaaggagtacatcgtgttctacaccagcctgttcggcagcctgatcctgctgctggccttcatcctgagcgtgaccctgaccaaggtgctggacctgctggccaagaccaacgtgatctactgcgaggagtgcagcatgtaccaccccagaaagggcatcaagtacaacggcgacttcaccaacaagtgcggcttctgcacctgcgacgagcaggaggacgtggagggcgtgatcatccacaaggtgagcaagaagtgcacctacagataccaggtgaagtgggccaagatcatcatgatcatcgtggtgatcctgctgatggcccagaacaccatcctgatcgtggccgccgagaccgactgctggaccaagaagagcctggagctggactgcatcggccccctgctgaacatcggcagctgcagcggcaaggaggccagaacctacgagaccgaggtgaagaagctggtgagccagagcaaggtgacccacatcgacgccgagcacatcagcatcctgggcgccaccatcgacagcgccatcaagagcatcagagcccagaagacctacgccaccatgcacctgctggagaccgtgttcctgatgaagaactgcgactactacaccgtgttcgagcacaacagcggctacagccaggccaagtggagactgatcgccaagaccaaccacttcgacatctgcagcagacacagcgcccaccacttctgcagatgcatcaacgacgagaccaagtgccagaacggcaactgggacttcgccggcgagatgaacaacacctacagcaccaagaaggacttctacagacacgacctggacctgttctacaccatcttcgagaacgccttccccggcagcaccgagagcctgttctaccacctgctgcagaccaagaacaccaccggcgccagcagaatcctggagaagctgagcaccaagttcggcaacaacaacatgttcgtgggcatctggaagttcggccagtacctgctgaccctgccctacgtgaacgagaccgagctgagccccagcagacagagcaccatcctgaccaacagcaacagcctgagcagaagcaccggcagacaggagagcctgagcagcgccatccccggccccaacaccaaggagtgcagcaacgccagagacgtgggctgcatcagccccagattcggcatccccatcggcaacctgaccgcctgcggcgagagccccagctacaagatctacaagacccccgagaagctgtacaagagcaacaacaagggcgagatctggtgcagcgacgacgtgcactgcctgaagaacttcgagcccgccaccgaggagatcgtgaacagaatcaagcagatgacctgcttcctgaccgacgtgagcaccaagaccgacatcttcagcatcgccaccagcacctgcagaatggtggacaagggcgtgtgcaccgtgaacgacgccaagtggaacatcctgaagtgcgacagcggcctgttctacttcaccgaccagagagagggccaggacaccggcaacgacttcggcgagtactgcatcagccacagctgcaacaccgagagattccccatcaaccccgacatcctgaaggactgcacctgggagtaccacagcagaaagagcaagtacatcagcaccatcagcctggagagcctggacgagttcagaagagccatgagcgacaagctgagccacaccctgatgatctacaacttcaagcccaccgccaacctgccccacatcaagcccacctacaagttcatcaccgccaacggcatcgagaacagcgacggcctggacagcgcctacatcgtgagcagcatccccgccctgggcggcatgagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcgcctgccccacccagatcccccacaaggacaactggctgaccttcagccaggagagaaccagcagatggggctgcgaggagttcggctgcctggccatcaacaccggctgcgtgttcggcagctgccaggacatcatccaccccgagaccaaggtgtacagaaaggccatggaggaggaggtgatcctgaccgtgtgcgtgaccttccccggcaacacctactgcaccgagatcaacgccatcgagcccaagatcaccgacgagatcgagctgcagttcaagaccgtggacaccaagaccctgcccaacatcctggccgtgcagaaccacaagctgtacagcggccagatcaacgacctgggcagcttcagccagggctgcggcaacgtgcagaagaccaaccagagcatcctgggcaccggcaccgccaagttcgactacgtgtgccacggcgccagcagaaaggacatcatcgtgagaagatgctacaacaacaaccacgacagctgcaagctgctgaaggaggagaccagcctgatcttcgccgacaaccacgagaccctggtggtggccaacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcatcaccaacatcgacaccgtgtgcagcgtgagcggcccctgcaccctgttccacaacagactgatcatcaccgccaccaagcagagctacggcatcaagatgagctgccccaccaagcccgagggcaccgagaccttcgagatctgcaacaagcagtacaagatcttcttcaccaccatcgacaagaacgacaagatcgagatcaacaccggcgaccagaccagctacatctacgagaaggacaacagatgcaagacctggctgtgcagagtgagagacgagggcatcagcgtgctgttcgagcccctgagagccttcttcggcagctacttcagcatcatcttctacgccgtggtgggcatcatcatcctgttcctggccgtgtacatcttcctgcccatgatcttcaagctgagagacatgctgaagaagaacgagtacctgtacctgcaggagagcaagcacaagtga

SEQ ID NO: 9282 - RNA, 4305 nt, synthetic construct
  misc_feature 1..4305: note = derived and/or modified CDS sequence (opt4) from PLAV(75V3066)__KX100122.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacatcaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgagcagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccaagagaaacgtgatctactgcgaggagtgcagcatgtaccacagcaagagaggcatcaagtacaacggcgacttcaccaacaagtgcggcttctgcacctgcaacgagcaggaggacaccgagggcctggtgatccacaaggtgagcaagagatgcacctacaagtaccagctgaagtgggccaaggtgctgatgatcaccctggtgctgctgctgatcgcccagaacaccatcctgatcgtggccgccgagaccgactgctggaccaagaagagcctggacatcgactgcatcggccccatgctggacatcggcagctgcaccaacaagaacaccagaagctacgacgccgaggcccagaagctggtgagccagagcaagatcagccagctggacgccgaccaggtgagcctgctgggcaacagcatcgacagcgccatcaaggccatcagagcccagaagacctaccccaccatgcacctgctggagaccatcttcctgatgaagaactgcgactactacaccaacttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaaggtgctgggcaagctgatcaccaagtacggcaacaacaacatgttcgtgggcgtgtggaagttcggccagtacctgctgaccctgccctacatcaacaacaccgagctgagccagaacagaagactgaccatcctggccacccaggagatcctgagcagaagccacagcggcagacaggagagcatgagcaacgccatccagggcagcatcaccaaggagtgccacaacgccaagggcgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtgatcaacaagatcaagaagctgacctgcttcctgaccgacgtgagcgtggaggtggacatcttcagcgtggccgccagcacctgcaagatggccgacaagggcgtgtgcaccgtgaacggcgccaagtggaacatcatcaagtgcgacagcggcctgtactacttcaccgaccacagagagggccaggacaccggcaacgacttcggcgagtactgcatcagccacagctgcaacaccgagagattccccatcaaccccgacaccctgaaggactgcacctgggagttccacagcagaaagagcaagtacatcagcaccatcagcctggagagcctggaggagttcagaagagccatggccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatgaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtggtgctgaccgtgtgcatcaacttccccggcaacagctactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgtgaagttcgactacgtgtgccacggcgccagcagaaaggacgtgaccgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcgtgtacatcttcctgcccatgttcttcaagctgaaggacgtgctgaagagaaacgagtacctgtacctgcaggagctgaagcacaagtga

SEQ ID NO: 9283 - RNA, 4305 nt, synthetic construct
  misc_feature 1..4305: note = derived and/or modified CDS sequence (opt4) from PLAV(75V5758)__KX100128.1__GP
  source 1..4305: mol_type = other RNA
atggagctgctgatcatcatcctgctgctgggcagcgccgccagcagccccgtgagcaccagatgcttccacggcggccagctgatcgccgagagcagaagcgccaccagcatcagcgagttctgcctgaaggacgacgtgagcatgatcaagagcgaggtgacctacaccaagaacgacaccggcatctacggccacaacaaggtgttcagaagctggaccatcaaggactggaagctgtgcaaccccatccccaccgccggcggcagcatcaacgtgatcgaggtgaacagcgacctgagcctggccaccaaggcctacgtgtgcagcagagactgcaccatcaccatcgacaaggaggacgcccagatcatcttccagaccgacaagctgaaccacttcgaggtgagcggcaccaccctgagcagcggctggttcaagaccaaggccagcgtgaccctggacagaacctgcgagcacatcaaggtgacctgcggcaagaagagcctgcagttccacgcctgcttcaagcaccacatgagctgcatcagattcttccaccacaccatcctgcccggcaccatggtgagcagcatgtgccagaacatcgagctgatcatcatcatcggcctgaccctggccatcttcatcctgatggtgatcctgaccaagacctacatctgctacctgctgatgcccgtgttcatgcccatcgcctacatctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagaatgctgtgcaagagcaagggcagcagcctggtgatcagcggcctgctgagcatgctgctgctgagcttcatcacccccatcgagggcaccctgaccaactaccccaacgagaagcagtacaccctggaggagatcgccgacgtggtggagggcatcatgaccgagcagcacctgaaggagtacgtggtgttctacaccagcctgttcggcggcctgatcctgctgctgaccctgatcctgagcatcaccatcaacaaggtgaccgacctgctggccagcaccaacgtgatctactgcgaggagtgcagcatgtaccacagcaagaagggcatcaagtacaacggcgacttcaccaacaagtgcggcttctgcacctgcagcgagcaggaggacgtggagggcgtggtgatccacaaggtgagcagaaagtgcacctacaagtaccagctgaagtgggtgagagtgatcatgatcatcctggccctgctgctgaccatccagaacaccgtgctgatcgtggccgccgaggtggactgctggaccaagaagagcatcgagatcgactgcatcggccccctgctgaacatcggcagctgcaccgacaagagcggcaagacctacgagaccgaggtgaacaagctggtgagacagagcaaggtgacccaggccgacgccgagcagatcagcgtgctgggcaacaccctggacagcgccatcaaggccatcagaagccagaagacctacgagaccatgcacttcctggagaccgtgttcctgatgaagaactgcgactactacagcagcttcgagcacaacagcggctacagccagaccaagtggagactgatcgccaagaccagccacttcgacatctgcagcagacacagcgcccaccacttctgcagatgcgtgaacgagggcaccaagtgccagaacggcgactgggacttcgccggcgagatgaacaacacctacaacagcaagaacgacttctacctgcacgacctggacctgttctacaccctgttcgagaacgccttccccggcaccaccgagagcctgttctaccagctgctgcagaagaagaacaccaccggcgccagcaagctgctgggcaagctgatcaccaagtacggcaacaacaacatgttcgtgggcatctggaagttcggccagtacctgctgaagctgccctacatcaacgacaccgagctgagcgccgacagaaagagcaccatcatgaagagccagcaggtgctgagcagaagccagaccggcagacaggagagcctgagcagcgccacccccggcaccgccaccaaggagtgcagcaacgccaaggacatcggctgcatcagccccagattcggcatccccatcggcaacctgaccgcctgcggcgacagccccaactacaagatctacaagacccccgagaagatctacaagagcaacaacaagggcgaggtgtggtgcagcgacgacgtgcactgcctggccgacttcgagcccgccgaggaggaggtggtgaacagaatcaagcagatgacctgcttcctgaccgacgtgaccaccaagaccgacgtgttcagcatcgccgtgagcacctgcaagatggtggacaagggcgtgtgcaccgtgaacgacgccaagtggaacatcctgaagtgcaacagcggcctgtactacttcaccgaccacagagacggccaggacaccggcaacgacttcggcgagtactgcatcagccacagctgcaacaccgagagattccccatcaaccccgacgtgctgaaggactgcatctgggagtaccacagcagaaagagcaagtacatcagcaccatcagcctggagagcctggacgagttcagaagagccatgagcgacaagctgagccacaccctgatgatctacaacttcaagcccaccgccaacctgccccacatcaagcccgcctacaagttcatcaccgccaacggcatcgagaacagcgacggcatcgacagcgcctacatcctgagcagcatccccgccctgggcggcatgagcgtgggctacaacgtgcagaccaaggacaacttccccctgctggacatcatcgtgttcatcaagagcgccatcatcaagaccacctacaaccacatctacgacaccggccccaccatcggcatcaacacccagcacgacgagcactgcaccggcccctgccccaccctgatcccccacaaggagaactggctgaccttcagccaggagagaaccagcagatggggctgcgaggagttcggctgcctggccatcaacaccggctgcgtgttcggcagctgccaggacatcatccaccccgaggccaaggtgtacagaaaggccatcgaggaggaggtggtgctgaccgtgtgcatcaccttccccggcaacacctactgcaccgagatcaacgccatcgagcccaagatcaccgacgagatcgagctgcagttcaagaccgtggacaccaagaccctgcccaacctgctgatggtgcacaaccacaagctgtacagcggccagatcaacgacctgggcagcttcagccagggctgcggcaacgtgcagaagaccaaccagagcgtgatcggcgccggcaccgtgaagttcgactacgtgtgccacggcgccagcagaaaggacgtgatcgtgagaagatgctacaacaacaactacgagagctgcaagctgctgaaggaggagaccagcctgatcttcgccgacaaccacgagaccctggaggtggccaacaccaagcacctgatcggcgagctgcagttcaagatcatgctgggcgacatcagatacaagagcttcgccgagagccccgagctggaggtggacgccaagtgcgtgggctgccccagctgcttcgagagctacagctgcaacttccagatcgtgaccaacatcgacaccgtgtgcagcgtgaacggcccctgcaccctgttccacaacagactgatcatcagcgccaccaagcagagctacggcctgaagatgagctgcagcagaaagcccgagcccaccgaggagttccagatctgcaacagaaagtacagcgtgctgttcaccaccatcgacaagaacgacaagatcgagatcaacaccggcgaccagaccagctacatctacgagaaggacaacagatgcaagacctggctgtgcagagtgagagacgagggcatcagcgtgatcttcgagcccctgaaggccttcttcggcagctacttcagcatcatcttctacgtgatcgtgggcatcatcgtgctgttcctgatcgtgtacatcttcctgcccatgttcttcaagctgagagacatcctgaagagaaacgagtacctgtacctgcaggagctgaagcacaagtga

SEQ ID NO: 9284 - RNA, 4317 nt, synthetic construct
  misc_feature 1..4317: note = derived and/or modified CDS sequence (opt4) from POTV(89-3380)__EU004189.1__GP
  source 1..4317: mol_type = other RNA
atggagccccccatgaagctgttcctgatcctggccaccgccgtggccgccgtgtacagcctgcccgccagcagatgcttcagcgacggcatcatcatcaaggagaagcaggacagcaaggccgtgagcgagttctgcctgaaggacgacgtgagcatgatcaagagccacgtggtgtacagcaagaacgagagcggcatcttcgccaacagccagatcctgagaaagtggatcatcaaggactggaagctgtgcagccccctgcccaccgccggcggccagatcaacgtgatcgagatcaaccacgacctgaccctgagcaccaagacctacgtgtgcaccaccgactgcaccatcggcatcgacaaggagaacgcccagatcaccttccagaccaacaagctgaactacttcgaggtgagcggcaccaccatcagcagcggctggttcaagagcaagaccagcgtgagcctggaccagacctgcgagcacctgaaggtgagctgcggcaagaagagcatgcagttccacgcctgcttcaagcagcacatgagctgcatcagatacctgcacaagaccgccctgcccggctacatggccgccagcatctgcagcaacatcgagctgatcatcatgaccaccctgaccctggccatcttcatcctgctgtgcatcatcaccaagacctacatctgctacctgctgatgcccctgttcatgcccatcgcctacatctacggctggctgtacaacaagagctgcaagaagtgcaactgctgcggcctgagctaccaccccttcaccaactgcggcagctactgcgtgtgcggcgccaagttcgagaccagcgacagaatgagaatccacagagagagcggcctgtgccagggctacaagagcctgagagtggccagaaagctgtgcaagagcaagggcagcagcctggtgatcagcgtgaccctgagcgtgttcatcttcagcttcatcacccccatcggcggcgtgatcatcaacgacaagctgagcgaggagaagtacagcatcaaccagatgatggacgccatcgtggacctggagaacttcagccacaacgtgagcggcacccagcaggtgatcagcgtgatcttcctgctgatcagctgcctgttcctgctgctgacctacagactgaacaagatcatccagcacctggccagaagcggcctgctgttctgcgaggagtgcagcatgtaccacagcaagaaggacatcaagtacaacggcgacttcaccaacaagtgcggcttctgcacctgcggccagcccgaggaccccgagggcctgaacctgcacatcctgagccagaactgcacctacaagcagcagttcaagtgggtgaagatcatcatcagcatcctgctgagcctgatcatcatcgagagcagcatgatcctggccgccgccgagaccgactgcttcagcgagaagcagatcagcgagttctgcctgggccccctgctgagcatcagcagctgcgaggacaagaacagcagaaccttcaagggcgaggcccagaagctggtggccctgaagaagatcaccagcgacgaggccatgctgatcgagagcatgggcgccaaggtggaggacgccctgaagatgatccaggcccagaagagccccgacagcatgtacaccatggagtacgtgttcctgaacacctactgcgactactacagcctgttcgagcacaacagcggctacagccagatcaagtggagatacatcctgaagacccaccagttcgacgcctgcgccagacacagcaacaaccacttctgcagatgcatgagcgacggcatgcactgccccagcctggactgggacatcgccgacgagctgaacaacacctacatcaccaagcccaacttcttcaagcacgactacaacctgctgctggacgtgatcaccgccgccttccccggcaccggcgccgtgttcgtgatcgacgcctgcaagaaggccaacgccaccgccatcaagaccttcagcaacaacatcatcgccagattcccctacaacaacctgctgaagggcgtgatgaagttcctgcagtacatcagcaagcaccccagcttcaagaagtaccagcccgacaccagacactacgacctgatccccgtggcccccaccgccagaggcagaagcctgggcagaagcaacagctacagcgacgcccaggtgggcccccccaccaaggactgccagaagctgaaggaggtgggctgcctgagccccaagttcggcctgcccctggagagcatcatcagctgcggcagcagccccaactacaagctgtacaagaagccccagaagtactacaagagcaacaacaaggagaacacctggtgcagcaaggacgtgcactgcctgcacgacttcgagcccatcaccgaggacgtgctggagaaggtgaaggtgatgacctgctgggagatcgagcccggcaccatcgaggacatcttcaccatcgccagcgagacctgcaagatcaacgacagaggcgtgtgcgaggtgaacgccgccaagtggaagatcgtgaagtgcgagaccggcctgtactactacaccgaccacagagagggcgacgacaccggcagcgacctgggccactactgcctgacccacaagtgcgccggcggcagataccccatcaaccccgagatcctgcagaactgcatctgggagttccacagccagaagagccagtacatcaaccaggtggacctggagcagatcgaggagtacaagaaggccctgaccgagaagctgacccacaccctgaaccactacaacttcctgcccaccaagaacctgccccacatcagccccaactacaagtacgtgaccctgaacggccaggagaccagcgacggcatcgagaacagctacatcgtgagcgagatccccgccatcgccggcaccagcatcggcctgaaggtgcagaccaagaacaacggcaacatcttcgacctgatcatctacgtgaagagagccgacatcatcgccagctacaaccacatctacgacaccggccccaccatcggccacaacgtggagcacgaggagctgtgcaccggccagtgcccccagcacatccccgccaaggccaactggctgaccttcagccaggagagaaccagcagatggggctgcgaggagttcggctgcctggccatcaacaccggctgcgtgtacggcagctgccaggacatcatcaagcccgtggccaaggtgtacagaaagagcaccgaggagaaggtggagctggagctgtgcatcgtgctgcccgacagaaacttctgcaccaccctgaacgccctggagcccaagatcaccgaggagatcgagctgcagttcaagaccatcgaccaggtgagcctgcccaacatcgtgctgctgagagaccacaagctgttcaagggccagatcaacgacctgggcaccttcggccagaactgcggcaacgtgcagaagaccaaccagagcatcctgggcgccggcaccgtgagattcgactacctgtgccacagcgccagcagaaaggacatcatcatcagaagatgctacaacaacaactacgacagctgcaaccacctgcagctggccgagagcctgatcttcctggacaaccacgagaccctggaggtgagaaagcccaaccacatcctgggcaccctgagcatgaagctgatgctgggcgacttccagtacaagaccttcgccaaggacatcgagctggacttcaccggcagatgcgtgggctgcatcggctgcttcgagggcttcgtgtgcgagatgcacatcaccaccaccgtggaggccacctgcaacctggaggccagctgccagttcttccacaaccagctgcacatcaagcccgacgtgctgaagtactacaccaagatgacctgccagaccgacgagtacatccccagcaagatcaagatctgcaacaaggagtacaagatcaccatcggcaaggtgagaaagaacgacaagatcgagatcgacaacagcgaccagaccagctacatcaaggagaaggacgagagatgcaagacctggctgtgcagagtgagagacgagggcatcagcgtgatcttcgagcccctgctgaacatcttcggcaactacggcagaatcgccgtggccgtgatcagcgccatcctggccctgatcgtgctggtgtacatcctgatgcccatctgcatgaagatcagagacatcctgaagaccaacgagaaggagttcctgatcgagagcaagtacaagtga

SEQ ID NO: 9285 - RNA, 4311 nt, synthetic construct
  misc_feature 1..4311: note = derived and/or modified CDS sequence (opt4) from TENV(TSV-FE3-66FB)__FJ943508.1__GP
  source 1..4311: mol_type = other RNA
atggagatcttcttcatcgccctgctggccatcgccaacagcgtgaacagcacccccctggccaccagatgcttccacggcggccagctgatcgccgagagcaagagcgccaccagcctgagcgagttctgcctgaaggacgacgtgagcatgatcaagagcgagatctactacgtgaagaacgagaccggcatcttcagccacaacaaggtgctgagaagctggaccatcaaggactggaagttctgcaaccccgtgcccaccgccggcggcagcatcaacgtgatcgaggtgaacagcgacatgagcctggccaccaagacctacgtgtgcagcagagactgcaccatcaccatcgacagagaggaggcccagatcatcttccagaccgagaagctgaaccacttcgaggtgagcggcaccaccctgagcagcggctggttcaagagcaaggccagcgtgaccctggacagaacctgcgagcacctgaaggtgacctgcggcaagaagagcctgcagttccacgcctgcttcaagcaccacatgagctgcatcagattcttccacaacaccatgctgcccggcagaatcgtgaacagcatgtgccagaacatcgagctgatcatcatcctgggcctgaccatcgtgatcttcatcctgatggtgatcctgaccaagacctacatctgctacatcctgatgcccctgttcatgcccatcgcctacatctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcatcctgctgagcatgctgctgctgagcttcgtgacccccatcgagggcgccctgaccaactacccccagagcaagctgtacagcctggaggagatcgccgacgtggtggagggcctgatcaccgagcacaacgtgaaggagtacatcgtgttctacaccagcctgttcggcggcctgatcctgctgctggccttcatcctgagcatcatgctgaccaaggtgaccagcatgctggccagaaccaacgtgatctactgcgaggagtgcagcatgtaccacagcaagaccggcatcaagtacaacggcgacttcaccaacaagtgcggcttctgcacctgcgacgagcaggaggacgccgagggcatcatcatccacaaggtgagcaagaagtgcacctacaagtaccagctgaagtgggccagaatcatcatgatcatcctgatcgtgctgctgaccacccagaacaccatcctgatcgtggccgccgaggtggactgctgggagagagccaccctgagccaggagtgcatcggccccctgcagaagatcgaggactgccagaacaaggaggagaagacctacatgagcgaggccaacaagctggtgagccagagcaagatcacccaggccgacgccgaccaggtgagcgtgctgggcgacaccatcgacagcgccatcaaggccatcagaagccagaagacctaccagaccatgcacctgctggagaccgtgttcctgatgaagaactgcgactactacagcaccttcgagcacaacagcggctacagccaggccaagtggagactgatggccaagaccaaccacttcgacatctgcagcagacacagcaaccaccacttctgcagatgcgtgaccgagggcaccaagtgccagaacggcgactgggacttcgccggcgagatgaacagcacctacaacaccaagagcgacttctaccagcacgacctgaacctgttcttcagcctgtacgagagcgccttccccggcaccgccgagagcctgttctaccagctgatcagcgagaagaacaccaccggcgccagccagctgctgggccagatcatcaagaagttcgccaacaacaacatgctgatcggcgtgtggaagttcggccagtacctgctgaccctgccctacgtgaacaccaccaagctgagcaagagcagagaggagaccatcctgaccaaccaccagagactggtgagaagctacaccggcagacagcagagcatggccaacgccgaggtgggcgagagcaccaagaactgcctgaacgccaagaacgtgggctgcatcagccccagattcggcgtgcccatcggcaacctgaccgtgtgcggcgagagcaccaactacaaggtgtacaagacccccgccaagatctacaagagcaacaacagacccaagacctggtgcagcgaggacgtgcactgcctgagcaacttcgagcccgccagcgccgaggtggtgaacaagatcaagagaatgacctgcttcctgaccgacgtgaccaccaacgtggacgtgttcagcatcgccatcagcacctgcaagatggccgacaagggcgtgtgcaccgtgaacgacgccagatggagcatcctgaagtgcgacagcggcctgctgtacttcaccgaccacagagagggccaggacaccggcaacgacttcggcgagtactgcatcagccacaactgcaacaccgagagataccccatcaaccccgacatcatcaaggactgcatctgggagtaccacagcagaaagagcaagtacatcagcgccatcaacctggagagcctggaggagttcagaagagccatgagcgagaagctgagccacaccctggtgatctacaacttcaagcccaccgccaacctgccccacatcaagcccagctacaagagcatcaccgtgaacggcatcgagaacagcgacggcatcgagagcgcctacatcctgagcaacatccccgccatcggcggcatgagcgtgggctacaacgtgctgaccaaggacggcttccccctgctggacatcatcatcttcatcaagagcgccgtgatcaagaccacctacaaccacatctacgacaccggccccaccatcggcatcaacaccctgcacgacgagaagtgcaccggcccctgccccagcatcatcccccacaaggagaactggctgaccttcagccaggagagaaccagcagatggggctgcgaggagttcggctgcctggccatcaacaccggctgcgtgttcggcagctgccaggacatcatcagacccgagaccaagatctacagaaaggccgtggaggaggaggtgatcctgaacgcctgcatcaacttccccggcaacacctactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacatcggcaccttcagccagggctgcggcaacgtgcagaagaccaaccagaccatgctgggcaccggcaccgtgagattcgactacgtgtgccacggcgccagcagaaaggacatcatcgtgagaagatgctacaacaacaactacgagagctgcaagctgctgaaggaggagaagagcctgatcttcgccgacaaccacgagaccctggaggtggccaacaccagacacctgctgggcgagctgcagttcaagatcatgctgggcgacatcagatacaaggccttcgccgagaagcccgagctggagatcgacgccaagtgcgtgggctgccccagctgcttcgagagctacagctgcaacttccagatcgtgagcaacgtggacaccgtgtgctacatcgagggcccctgcaccctgttccacaacagaatcatcatcaagaccatgaagcaggcctacggcatcaagatgagctgcaagaccaagcccgcccccagcgaggagttcaagatctgcggcagaacctacaacgtggccttcaacaccgtggagaagaacgacaagatcgagatcaacaccggcgaccagaccagctacatcagcgagaaggacgacagatgcaagacctggctgtgcagagtgagagacgagggcatcagcgtgatcttcgagcccctgaagaacctgttcggcaactacttcaacatcgccttctacatcatcatcggcctgatcgccctgttcctgaccatctacatcttcctgcccatgttcttcaagctgagagacgtgctgaagagaaacgagtacctgtacctgcaggagctgaagcacaagtga

SEQ ID NO: 9286 - RNA, 4311 nt, synthetic construct
  misc_feature 1..4311: note = derived and/or modified CDS sequence (opt4) from TENV(TSV-FL06)__FJ943506.1__GP
  source 1..4311: mol_type = other RNA
atggagatcttcttcatcgccctgctggccatcgccagcagcgtgaacagcacccccctggccaccagatgcttccacggcggccagctgatcgccgagagcaagagcgccaccagcctgagcgagttctgcctgaaggacgacgtgagcatgatcaagagcgagatctactacgtgaagaacgagaccggcatcttcagctacaacaaggtgctgagaagctggaccatcaaggactggaagttctgcaaccccgtgcccaccgccggcggcagcatcaacgtgatcgaggtgaacagcgacatgagcctggccaccaagacctacgtgtgcagcagagactgcaccatcaccatcgacagagaggaggcccagatcatcttccagaccgagaagctgaaccacttcgaggtgagcggcaccaccctgagcagcggctggttcaagagcaaggccagcgtgaccctggacagaacctgcgagcacctgaaggtgacctgcggcaagaagagcctgcagttccacgcctgcttcaagcaccacatgagctgcatcagattcttccacaacaccatgctgcccggcagaatcgtgaacagcatgtgccagaacatcgagctgatcatcatcctgggcctgaccatcgtgatcttcatcctgatggtgatcctgaccaagacctacatctgctacatcctgatgcccctgttcatgcccgtggcctacatctacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcatcctgctgagcatgctgctgctgagcttcgtgacccccatcgagggcgccctgaccaactacccccagagcaagctgtacagcctggaggagatcgccgacgtggtggagggcctgatcaccgagcacaacgtgaaggagtacatcgtgttctacaccagcctgttcggcggcctgatcctgctgctggccttcatcctgagcatcatgctgaccaaggtgaccagcatgctggccagaaccaacgtgatctactgcgaggagtgcagcatgtaccacagcaagaccggcatcaagtacaacggcgacttcaccaacaagtgcggcttctgcacctgcgacgagcaggaggacgccgagggcatcatcatccacaaggtgagcaagaagtgcacctacaagtaccagctgaagtgggccagaatcatcatgatcatcctgatcgtgctgctgaccacccagaacaccatcctgatcgtggccgccgaggtggactgctgggagagagccaccctgagccacgagtgcatcggccccctgcagaagatcgaggactgccagaacaaggaggagaagacctacatgagcgaggccaacaagctggtgagccagagcaagatcacccaggccgacgccgaccaggtgagcgtgctgggcgacaccatcgacagcgccatcaaggccatcagaagccagaagacctaccagaccatgcacctgctggagaccgtgttcctgatgaagaactgcgactactacagcaccttcgagcacaacagcggctacagccaggccaagtggagactgatggccaagaccaaccacttcgacatctgcagcagacacagcaaccaccacttctgcagatgcgtgaccgagggcaccaagtgccagaacggcgactgggacttcgccggcgagatgaacagcacctacaacaccaagagcgacttctaccagcacgacctgaacctgttcttcagcctgtacgagagcgccttccccggcaccgccgagagcctgttctaccagctgatcagcgagaagaacaccaccggcgccagccagctgctgggccagatcatcaagaagttcgccaacaacaacatgctgatcggcgtgtggaagttcggccagtacctgctgaccctgccctacgtgaacaccaccaagctgagcaagagcagagaggagaccaccctgaccaaccaccagagactggtgagaagctacaccggcagacagcagagcatggccaacgccgaggtgggcgagagcaccaagaactgcctgaacgccaagaacgtgggctgcatcagccccagattcggcgtgcccatcggcaacctgaccgtgtgcggcgagagcaccaactacaaggtgtacaagacccccgccaagatctacaagagcaacaacagacccaagacctggtgcagcgaggacgtgcactgcctgagcaacttcgagcccgccagcgccgaggtggtgaacaagatcaagagaatgacctgcttcctgaccgacgtgaccaccaacgtggacgtgttcagcatcgccatcagcacctgcaagatggccgacaagggcgtgtgcaccgtgaacgacgccagatggagcatcctgaagtgcgacagcggcctgctgtacttcaccgaccacagagagggccaggacaccggcaacgacttcggcgagtactgcatcagccacaactgcaacaccgagagataccccatcaaccccgacatcatcaaggactgcatctgggagtactacagcagaaagagcaagtacatcagcgccatcaacctggagagcctggaggagttcagaagagccatgagcgagaagctgagccacaccctggtgatctacaacttcaagcccaccgccaacctgccccacatcaagcccagctacaagagcatcaccgtgaacggcatcgagaacagcgacggcatcgagagcgcctacatcctgagcaacatccccgccatcggcggcatgagcgtgggctacaacgtgctgaccaaggacggcttccccctgctggacatcatcatcttcatcaagagcgccgtgatcaagaccacctacaaccacatctacgacaccggccccaccatcggcatcaacaccctgcacgacgagaagtgcaccggcccctgccccagcatcatcccccacaaggagaactggctgaccttcagccaggagagaaccagcagatggggctgcgaggagttcggctgcctggccatcaacaccggctgcgtgttcggcagctgccaggacatcatcagacccgagaccaagatctacagaaaggccgtggaggaggaggtgatcctgaacgcctgcatcaacttccccggcaacacctactgcaccgagatcaacgccttcgagcccaagatcaccgacgagatcgagctgcagttcaagaccgtggacaccaagaccctgcccaacctgctggccgtgcagaaccacaagctgtacagcggccagatcaacgacatcggcaccttcagccagggctgcggcaacgtgcagaagaccaaccagaccatgctgggcaccggcaccgtgagattcgactacgtgtgccacggcgccagcagaaaggacatcatcgtgagaagatgctacaacaacaactacgagagctgcaagctgctgaaggaggagaagagcctgatcttcgccgacaaccacgagaccctggaggtggccaacaccagacacctgctgggcgagctgcagttcagaatcatgctgggcgacatcagatacaaggccttcgccgagaagcccgagctggagatcgacgccaagtgcgtgggctgccccagctgcttcgagagctacagctgcaacttccagatcgtgagcaacgtggacaccgtgtgctacatcgagggcccctgcaccctgttccacaacagagtgatcatcaagaccatgaagcaggcctacggcatcaagatgagctgcaagaccaagcccgcccccagcgaggagttcaagatctgcggcagaacctacaacgtggccttcaacaccgtggagaagaacgacaagatcgagatcaacaccggcgaccagaccagctacatcagcgagaaggacgacagatgcaagacctggctgtgcagagtgagagacgagggcatcagcgtgatcttcgagcccctgaagaacctgttcggcaactacttcaacatcgccttctacatcatcatcggcctgatcgccctgttcctgaccatctacatcttcctgcccatgttcttcaagctgagagacgtgctgaagagaaacgagtacctgtacctgcaggagctgaagcacaagtga

SEQ ID NO: 9287 - RNA, 4305 nt, synthetic construct
  misc_feature 1..4305: note = derived and/or modified CDS sequence (opt4) from TLAV(61D240)__KX100119.1__GP
  source 1..4305: mol_type = other RNA
atgctgttcctgctgatcctggccttcctgggcttcagcaccagcaaccccatcgccaccagatgcttccacggcggccagctgatcgccgagagcaagagcgccaccagcatcagcgagttctgcctgaaggacgacgtgagcatgctgaagagcgaggtggtgtacaccaagaacgacaccggcctgttcggccacaacaaggtgttcagaagctggaccatcaaggactggaagctgtgcaaccccatccccaccgccggcggcaccatcaacgtgatcgaggtgaacaaggacctgagcctgatgaccaagacctacatctgcagcagagactgcaccatcaccatcgacaaggaggaggcccagatcatcttccagaccgacaagctgaaccacttcgaggtgagcggcaccaccctgaacagcggctggttcaagagcaaggccagcgtgaccctggacagaacctgcgagcacgtgaaggtgacctgcggcaagaagagcctgcagttccacgcctgcttcaagcaccacatgagctgcgtgagattcttccacaacaccatcctgcccggcaacatgatcaccagcatgtgccagaacatcgagctgatcatcatcctgggcctgaccctggccatcttcatcctgatggtgatgctgaccaagacctacatctgctacctgctgatgcccatcttcatgcccatcgcctacctgtacggctgggcctacaacaagagctgcaagaagtgcaactgctgcggcctggcctaccaccccttcaccaactgcggcagccactgcgtgtgcggcctgaagttcgaggccagcgacagaatgagaatccacagagagagcggcctgtgccagggctacaagagcctgagaatcgccagactgctgtgcaagagcaagggcagcagcctggtgatcagcggcctgctgagcatgctgatcctgagcttcgtgacccccatcgagggcaccatcaccagctaccccgagagcagaaagtacaccctggaggagatcaccgacgtggtggagggcctggtgagcgagcagaacatcaaggagtacatcgtgttctacaccagcctgttcggcagcctgatcctgctgctggccttcatcatgagcatcaccctgagcaagatcaccagcatcctggccagaagaaacgtgatctactgcgaggagtgcagcatgtaccacagcaagagaggcatcaagtacaacggcgacttcaccaacaagtgcggcttctgcacctgcaacgagcaggaggacgccgagggcctggtgatccacaaggtgagcaagagatgcacctacaagtaccagctgaagtgggccaaggtgctgatggtgaccctggtgctgctgctgatcgcccagaacaccatcctgatcgtggccgccggcaccgactgctggaccaagaagagcctggacatcgactgcatcggccccatgctggacatcggcagctgcaccaacaagaacaccagaaactacgacaccgaggcccagaagctggtgagccagagcaaggtgagccagctggacgccgaccaggccagcctgctgggcaacagcatcgacagcgccatcaaggccatcagagcccagaagacctaccccaccatgcacctgctggagaccatcttcctgatgaagaactgcgactactacaccagcttcaaccacaacagcggctacagccaggccaagtggagactgatcgccaagaccggccacttcgacatctgcagcagacacagcacccaccacttctgcagatgcatcaacgacggcaccaagtgccagaacggcgactgggacttcgccggcgagatgaacgagacctacaacagcaagaacgacttctacagccacgacctgaacctgttctacaccatcttcgagaacgccttccccggcaccaccgagagcctgttctaccagctgatccagaagaagaacaccaccggcgccagcaagatcctgggcaagctgatcaccaagtacggcaacaagaacatgttcgtgggcgtgtggaagttcggccagtacctgctgaccctgccctacatcaacaacaccgagctgagccagaacagaagacagaccatcctggccacccaggagagcctgagcagaagccacagcggcagacaggagagcatgagcagcgccatccagggcagcgtgaccaaggagtgccacaacgccaaggacgtgggctgcatcagccccagattcggcatccccatcggcaacctgaccgcctgcggcgacagccccaactacaagatctacaagacccccgagaagctgtacaagagcaacaacaagggcgaggtgtggtgcagcaacgacgtgcactgcctgaacgacttcgagcccgccgacgaggaggtggtgaacaaggtgaagaagctgacctgcttcctgaccgacgtgagcgtgaagaccgacatcttcagcgtggccgccagcacctgcaagatggccgacaagggcgtgtgcaccgtgaacgacgccaagtggaacatcatcaagtgcgacagcggcctgtactacttcaccgaccacagagagggccaggacaccggcaacgacttcggcgagtactgcatcagccacagctgcaacaccgagagattccccatcaaccccgacatcctgaaggactgcacctgggagttccacagcagaaagagcaagtacatcagcaccatcagcctggagagcctggaggagttcagaagagccatgaccgagaagctgagccacaccctgaccatctacaacttcaagcccaccgccaacctgccccacatcagacccacctacaagttcatcaccgccaacggcgtggagaacagcgacggcatcgagagcgcctacatcctgagcagcatccccgccctgggcggcatcagcgtgggctacaacgtgcagaccaaggacaacttccccctgctggacatcatcgtgttcatcaagagcgccgtgatcagaaccacctacaaccacatctacgacaccggccccaccatcggcatcaacacccagcacgacgagcactgcaccggcccctgccccgccgtggtgccccacaaggagaactggatcaccttcagccaggagagaaccagcagatggggctgcgaggagttcggctgcctggccatcaacaccggctgcgtgttcggcagctgccaggacatcatccaccccgagaccaaggtgtacagaaaggccgtggaggaggaggtgatcctgaccgtgtgcatcaacttccccggcaacaactactgcaccgagatcaacgccatcgagcccaagatcaccgacgagatcgagctgcagttcaagaccgtggacaccaagaccctgcccaacctgctggccgtgcagaaccacaagctgtacagcggccagatcaacgacctgggcagcttcagccagggctgcggcaacgtgcagaagaccaaccacagcatcctgggcatgggcaccgccaagttcgactacgtgtgccacggcgccagcagaaaggacgtgatcgtgagaagatgctacaacaacaacttcgacagctgcaagctgctgaaggaggagaccagcctgatcttcgccgacaaccacgagaccctggaggtggcccacaccaagcacctgatcggcgagctgcagttcaagatcatgctgggcgacatcagatacaagagcttcgccgagagccccgagctggagatcgacgccaagtgcgtgggctgccccagctgcttcgagagctacagctgcaacttccagatcgtgaccaacatcgacaccgtgtgcagcgtggagggcccctgcaccctgttccacaacagaatcatcatcagcgccaacaagcagagctacggcctgaagatgagctgccagaccaagcccaaccagaacgaggagttcatcatctgcaacagaaagtacagcgtgctgttcaccaccatcgacaagaacgacaagatcgaggtgaacaccggcgaccagaccagctacatctacgagaaggacagcagatgcaagacctggctgtgcagagtgagagacgagggcatcagcgtgctgttcgagcccctgaaggccttcttcggcagctacttcagcatcatcttctacgtggtggtgggcatcatcgtgctgttcctgatcatctacatcttcctgcccatgttcttcaagctgaaggacgtgctgaagagaaacgagtacctgtacctgcaggagctgaagcacaagtga

SEQ ID NO: 9288 - RNA, 4305 nt, synthetic construct
  misc_feature 1..4305: note = derived and/or modified CDS sequence (opt4) from NRIV(9800535)__AY593725.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatgatcatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctggtgatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgctgctgctgatcgccctggtgatcaccatcaccctgaacaaggtgaccgagtacctgaccaacatcaacgtgctgtactgctacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccagaaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgacctggacttcgccggcgagatgaacagcacctaccagagcaagaaggacttcttcgagcacgacttcaagctgttctgcaccctggtggagaacgccttccccggcaccaccgagagcctgttctacgagatgctgagcaagaagaacaccaccggcatcaagcagctgctggacaagctgaccagaaagttcggcaacaacaacatgttcgtgggcatctggaagttcggccagtacctgatgagcctgccctacatcaacgagaccagcctgacccccgcccagatcagcaagatcctggaggtgaccgaccagcaccacagaagcatcagcggcagacaggagagcctggccagcgccacccccggcagcaagagcaaggagtgcggccacgccaagaaggtgagctgcatcagccccagattcagcgtgcccatggagggcctgatggcctgcggcgacagccccaactacaagatctacaagacccccaccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccgccatcatcagagactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcgccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagagaaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtgatcagcatcatcgtgctgttcctggccatctacatcttcctgcccatggtgttcaagctgagagacgtgctgaagagaaacgagtacctgtacctgcaggagatcaagcacaagtga

SEQ ID NO: 9289 - RNA, 4305 nt, synthetic construct
  misc_feature 1..4305: note = derived and/or modified CDS sequence (opt4) from NRIV(GSA/TS7/5170/WT)__KM514677.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagagaaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctggtgatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgctgctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacagataccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccagcgagatgaacagcacctaccagagcaagaaggacttcttcgagcacgacttcaagctgttctgcaccctggtggagaacgccttccccggcaccaccgagagcctgttctacgagatgctgagcaagaagaacaccaccggcatcaagaacctgctggacaagctgaccagaaagttcggcaacaacaacatgttcgtgggcatctggaagttcggccagtacctgatcagcctgccctacgtgaacgagaccagcctgacccccgcccaggtgagcaagatcctggaggtgaccgaccagcaccacagaagcatcagcggcagacaggagagcctggccagcgccaccagcggcagcaagagcaaggagtgcggccacgccaagaaggtgagctgcatcagccccagattcagcgtgcccatggagggcctgatggcctgcggcgacagccccaactacaagatctacaagacccccgccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccaccatcatcagcgactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcagcgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtggtgatcatcatcgtgctgttcctggccatctacatcttcctgcccatggtgttcaagctgagagacgtgctgaagagaaacgagtacctgtacctgcaggagatcaagcacaagtga

SEQ ID NO: 9290 - RNA, 4305 nt, synthetic construct
  misc_feature 1..4305: note = derived and/or modified CDS sequence (opt4) from NRIV(TND/S1/19801/WT)__KM514679.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagagaaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctggtgatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgctgctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacagataccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccagcgagatgaacagcacctaccagagcaagaaggacttcttcgagcacgacttcaagctgttctgcaccctggtggagaacgccttccccggcaccaccgagagcctgttctacgagatgctgagcaagaagaacaccaccggcatcaagaacctgctggacaagctgaccagaaagttcggcaacaacaacatgttcgtgggcatctggaagttcggccagtacctgatcagcctgccctacgtgaacgagaccagcctgacccccgcccaggtgagcaagatcctggaggtgaccgaccagcaccacagaagcatcagcggcagacaggagagcctggccagcgccaccagcggcagcaagagcaaggagtgcggccacgccaagaaggtgagctgcatcagccccagattcagcgtgcccatggagggcctgatggcctgcggcgacagccccaactacaagatctacaagacccccgccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccgccaacgacttcggcgagtactgcctgagccacagctgcagaatcgagagattccccatcaaccccaccatcatcagcgactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcagcgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtggtgatcatcatcgtgctgttcctggccatctacatcttcctgcccatggtgttcaagctgagagacgtgctgaagagaaacgagtacctgtacctgcaggagatcaagcacaagtga

SEQ ID NO: 9291 - RNA, 4305 nt, synthetic construct
  misc_feature 1..4305: note = derived and/or modified CDS sequence (opt4) from NRIV(9800521)__JX857326.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatgatcatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctggtgatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgctgctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccagaaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctggtggagaacgccttccccggcaccaccgagagcctgttctacgagatgctgagcaagaagaacaccaccggcatcaagcagctgctggacaagctgaccagaaagttcggcaacaacaacatgttcgtgggcatctggaagttcggccagtacctgatgagcctgccctacgtgaacgaggccagcctgacccccgcccagatcagcaagatcctggaggtgaccgaccagcaccacagaagcatcagcggcagacaggagagcctggccagcgccacccccggcagcaagagcaaggagtgcggccacgccaagaaggtgagctgcatcagccccagattcagcgtgcccatggagggcctgatggcctgcggcgacagccccaactacaagatctacaagacccccaccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccgccatcatcagagactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcgccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagagaaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccaccaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtgatcagcatcatcgtgctgttcctggccatctacatcttcctgcccatggtgttcaagctgagagacgtgctgaagagaaacgagtacctgtacctgcaggagatcaagcacaagtga

SEQ ID NO: 9292 - RNA, 4305 nt, synthetic construct
  misc_feature 1..4305: note = derived and/or modified CDS sequence (opt4) from NRIV(Adrar)__KJ716849.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctggtgatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgctgctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccaagaagctggtgagagccagcaagatcagcgacctggacgccgcccaggtgggcctgctgggcagcaccatcgagagcgccatcgccagcatcagaaagcagagaacctaccccaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacttcaagctgttctgcaccctggtggagaacgccttccccggcaccaccgagagcctgttctacgagatgctgagcaagaagaacaccaccggcatcaagaagctgctggacaagctgaccagaaagttcggcaacaacaacatgttcgtgggcatctggaagttcggccagtacctgatcagcctgccctacgtgaacgagaccagcctgacccccgcccaggtgagcaagatcctggaggtgaccgaccagcaccacagaagcatcagcggcagacaggagagcctggccagcgccacccccggcagcaagagcaaggagtgcggccacgccaagaaggtgagctgcatcagccccagattcagcgtgcccatggagggcctgatggcctgcggcgacagccccaactacaagatctacaagacccccgccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagagggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccatctacaagtacatcaccgtgcagggcgtggagaacagcgacggcgtggacagcgcctacatcgccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagaagcgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacctgagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagaaggacgacagatgcaagacctggctgtgcagagtgagagacgagggcatcagcgtgatcttcgagcccatcagagccttcttcggcagctacttcagcatcgccttctacgtggtgatcagcatcatcgtgctgttcctggccatctacatcttcctgcccatggtgttcaagctgagagacgtgctgaagagaaacgagtacctgtacctgcaggagatcaagcacaagtga

SEQ ID NO: 9293 - RNA, 4305 nt, synthetic construct
  misc_feature 1..4305: note = derived and/or modified CDS sequence (opt4) from NRIV(DakArD28542)__JX857317.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgttcctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccaagaagctggtgagagccagcaagatcagcgacctggacgccgcccaggtgggcctgctgggccccaccatcgagagcgccatcgccagcatcagaaagcagagaacctacagcaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacctgaagctgttctgcaccctggtggagaacgccttccccggcaccaccgagagcctgttctacgagatgctgagcaagaagaacaccaccggcgtgaagaagctgctggacaagctgaccagaaagttcggcaacaacaacatgttcgtgggcatctggaagttcggccagtacctgatgagcctgccctacgtgaacgagaccagcctgacccccgcccaggtggccaagatcctggaggtgaccgaccagcaccacagaagcatcagcggcagacaggagagcctggccagcgccacccccggcagcaagagcaaggagtgcagccacgccaagaaggtgagctgcatcagccccagattcagcgtgcccatggagggcctgatggcctgcggcgacagccccaactacaagatctacaagacccccgccaagctgtacaagagcaacaacaagggcgaggtgtggtgcagcggcgacgtgcactgcagccaggagctgagccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcgccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtggtgagcatcatcgtgctgttcctggccatctacatcttcctgcccatggtgttcaagctgagagacgtgctgaagagaaacgagtacctgtacctgcaggagatcaagcacaagtga

SEQ ID NO: 9294 - RNA, 4305 nt, synthetic construct
  misc_feature 1..4305: note = derived and/or modified CDS sequence (opt4) from NRIV(SUD-HKV141)__JX857323.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctgagcatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgttcctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccaagaagctggtgagagccagcaagatcagcgacctggacgccgcccaggtgggcctgctgggccccaccatcgagagcgccatcgccagcatcagaaagcagagaacctacagcaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacggcaccaagtgccagaacggcgactgggacttcgccggcgagatgaacagcacctaccagagcaagaaggacttcttcgagcacgacctgaagctgttctgcaccctggtggagaacgccttccccggcaccaccgagagcctgttctacgagatgctgagcaagaagaacaccaccggcgtgaagaagctgctggacaagctgaccagaaagttcggcaacaacaacatgttcgtgggcatctggaagttcggccagtacctgatgagcctgccctacgtgaacgagaccagcctgacccccgcccaggtggccaagatcctggaggtgaccgaccagcaccacagaagcatcagcggcagacaggagagcctggccagcgccacccccggcagcaagagcaaggagtgcggccacgccaagaaggtgagctgcatcagccccagattcagcgtgcccatggagggcctgatggcctgcggcgacagccccaactacaagatctacaagacccccgccaagctgtacaagagcaacaacaagggcgaggtgtggtgcagcggcgacgtgcactgcagccaggagctgacccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcgccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgtgagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtggtgagcatcatcgtgctgttcctggccatctacatcttcctgcccatggtgttcaagctgagagacgtgctgaagagaaacgagtacctgtacctgcaggagatcaagcacaagtga

SEQ ID NO: 9295 - RNA, 4305 nt, synthetic construct
  misc_feature 1..4305: note = derived and/or modified CDS sequence (opt4) from NRIV(SUD-HKV66)__JX857320.1__GP
  source 1..4305: mol_type = other RNA
atgctgctgctgctggtgctgctgatcccctgctacgtgagcgccagccccgtggtgaccagatgcttccacggcggccagctgatcgccgagaagaagagccagaccgccgtgagcgagttctgcctgaaggacgacgtgagcaccatcaagagcgagatcacctacgagaagaacaacaccggcctgttcgcccacagcaaggtgctgagaaactggatcatcaaggactggaagaactgcaaccccgtgcccaccgccggcggcagcatcaacgtgatcgaggtgaacaccgacctgagcctgaccaccaagacctacgtgtgcagcagagactgcaccatcaccgtggacaaggaggacgcccagatcatcttccagaccgagaagctgaaccacttcgaggtgagcggcaccaccctgagcagcggctggttcaagaccaaggccagcgtgaccctggacagaacctgcgagcacatcaaggtgacctgcggcaagaagaccctgcagttccacgcctgcttcaagcaccacatgagctgcatcagattcttccacggcaccatcctgcccggcaccatggccaccagcatctgccagaacatcgagctgatcatcatcatcagcctgaccctgatcatcttcatcctgatggtgatcctgaccaagacctacatctgctacctgctgatgcccctgttcatgcccatcgcctacttctacggctggagctacaacaagagctgcaagaagtgcagctgctgcggcctggcctaccaccccttcaccaactgcggcagccactgcgtgtgcggcctgaagttcgaggccagcgacagaatgagaatccacagagagagcggcctgtgccagggctacaagagcctgagagtggccagactgctgtgcaagagcaagggcagcagcctgatcatcagcatcctgctggccatgctgatcctgagcttcgtgacccccatcgagggcaccctgaccaactaccccgagagcagaaagtacgacctggaggagatcgccgacgtgctggagggcttcatcgtggagaagggcatcaaggagtacgtggtgttctacaccagcatcttcggcgccctgttcctgctgatggccctggtgatcaccatcaccctgaacaaggtgaccgagtacctgaccaacatcaacgtgctgtactgccacgagtgcagcatgtaccacagcaagaagaacatcaagtacatcggcgacttcaccaacaagtgcggcttctgcacctgcggcgagctggaggaccaggagggcctgaagatccacaaggtgagcagaaagtgcatctacaagtaccagctgacctggagcaagatcatcatgaccatcctggtgtgcctgctgatcgcccagaacaccatcctgatcgtggccgccagcgacgactgctggaccaagaagagcctggagatggagtgcatcggccccctgcagcaggtggacacctgcgacgacaaggccagcagaagctacagcggcgaggccaagaagctggtgagagccagcaagatcagcgacctggacgccgcccaggtgagactgctgggccccaccatcgagagcgccatcgccagcatcagaaagcagagaacctacagcaccatgcacctgctggagagcgtgttcctgggcaagcactgcgactactacaagaccttcgagcacaacagcggctacagccaggccaagtggagactgaccgccaagacccaccacttcgacatctgcagcagacacagcacccaccacttctgcagatgcatcagcgacgccaccaagtgccagaacggcgactgggacttcgccggcgagatgaacagcacctaccagagcaagaaggacttcttcgagcacgacctgaagctgttctgcaccctggtggagaacgccttccccggcaccaccgagagcctgttctacgagatgctgagcaagaagaacaccaccggcgtgaagaagctgctggacaagctgaccagaaagttcggcaacaacaacatgttcgtgggcatctggaagttcggccagtacctgatgagcctgccctacgtgaacgagaccagcctgacccccgcccaggtggccaagatcctggaggtgaccgaccagcaccacagaagcatcagcggcagacaggagagcctggccagcgccacccccggcagcaagagcaaggagtgcggccacgccaagaaggtgagctgcatcagccccagattcagcgtgcccatggagggcctgatggcctgcggcgacagccccaactacaagatctacaagacccccgccaagctgtacaagagcaacaacaagggcgaggtgtggtgcagcggcgacgtgcactgcagccaggagctgacccccgccagccaggagagcgtggacagaatcaagcagatcacctgcttcctgaccgagcccgaggtgagcgacgacgtgttcagcatcgccatcagcacctgcaaggtgcaggacaagggcgtgtgcaccgtgaacgaggacagatggaacgtgatcaagtgcgacagcggcctgatctactacaccgaccagagagacggccaggacaccggcaacgacttcggcgagtactgcctgagccacagctgcagaatcgagagattccccatcaaccccgccatcatcagcgactgcctgtgggagtaccacagcagaaagagcaagtacatcaccagcctggacctggagaacctggaggagttcaagagagccatcagcgagaagctgagccacaccctgatcgtgtacaacttcaagcccaccgccaacctgccccacatcaagcccgtgtacaagtacatcaccgtgcagggcgtggagaacagcgacggcgtggacagcgcctacatcgccgccagcatgcccgccctgagcggcaccagcatcggctacaacatcatgagcagagacaacttccccctgttcgacatcatcatcttcatcaagagcgccatcatcaaggccacctacaaccacatctacgacaccggccccaccatcggcatcaacgtgatgcacgacgagcactgcaccggccagtgccccaccgacatcccccacaaggagaactggatcaccttcgcccaggagagaaccagcagatggggctgcgaggagttcggctgcctggccgtgaacaccggctgcgtgttcggcagctgccaggacatcatcagacccgagaccaaggtgtacagaaaggccgtggaggagagcgtgctgctgaccgtgtgcatcacctaccccggcaagaccttctgcaccgagatcaacgccatcgagcccaagatcaccgacgagctggagctgcagttcaagaccgtggacaccaagaccctgcccaacatcctggccgtgcagaaccacaagctgtacagcggccagatcaacgacctgggcagcttcagccagggctgcggcaacatccagaagaccaacagcagcatcatcggcaccggcaccgccaagttcgactacgtgtgccacggcgccagcagaaaggacatcatcgtgagaagatgctacaacaacaactacgagagctgcaagctgctgaaggaggagcagagcctgatgttcgccgacaaccacgagaccatcgacgtggccaacgtgagacacctgctgggcgacctgcagttcaagctgatgctgggcgacctgagatacaagagcttcgccgagaaccccgacctggagatcgaggccaagtgcgtgggctgccccagctgcttcaccagctacagctgcagcttcaagatcgccagcaacatcgacaccgtgtgcagcatcgagggcccctgcaccaccttccacaacagactgatgatcaccagcaccaagcaggactacggcatcaagatgagctgcaagaccaagcccaaggagaccgaggagttccagatctgcaagaagacctacaccgtgctgttcaccaccgtggagaagaacgacaagatcgagatcagcaccggcgaccagaccagcttcatccaggagagagacgacagatgcaagacctggctgtgcagagtgagagacgagggcatcagcgtgatcttcgagcccatcagagccttcttcggcagctacttcagcatcgccttctacgtggtggtgagcatcatcgtgctgttcctggccatctacatcttcctgcccatggtgttcaagctgagagacgtgctgaagagaaacgagtacctgtacctgcaggagatcaagcacaagtga

SEQ ID NO: 9296 - RNA, 4344 nt, synthetic construct
  misc_feature 1..4344: note = derived and/or modified CDS sequence (opt4) from BWAV(M459)__NC_034490.1__GP
  source 1..4344: mol_type = other RNA
atggccatgttcgagctgatcgtgctgctggccttcagctacgtgaccggcgtgccccaggagctgaccagatgcttcaccggcggcagcgtggtgagacagcactggagcaagaacgccatcagcgagctgtgcctgaaggacgacgtgagcatcatcaagagcgagatcgagtacaagaagaacgagaccggcaccttcgccctgagcaagatctacagaaagtggatcaccaccgactgggagaagtgccagccccagaagagcaccggcggccacatcagcgtgctggaggtgagacacgacctgaccctggccagcgccacctacatctgcggcaacccctgcaccatcaacgtggacagagagatggcccaggtgcacctgcagaccgagggcgtgaaccacttcgagatcagcggcaccaccatcaagagcggctggttcaagaccaccacctacatcaccctggaccagacctgcgagcacctgaaggtgagctgcggcaagcagagcgtgcagttccacgcctgcttcaagcagcacatggcctgcgtgagattcctgcacagaaccatcctgcccggcaacatggccaacagcatctgccagaacatcgagatcatcatcctgctggccctgaccctgagcatcttcatcctgctgtgcatcctgaccaagacctacatctgctacatcctgctgcccatcttcatccccatcagctacatctacggctacttctacaacagaagctgcaagaagtgcagccagtgcggcctggtgtaccaccccttcaccgagtgcggcagaaactgcgtgtgcggcgccagatacgacaccagcgagagaatgaagctgcacagactgagcggcctgtgccccggctacaagagcctgaaggccgccagagtgctgtgcaagagcaagggcagcgccagcatcctgagcatcctgatcagcctgctgatcctgaccttcgtgacccccatcaacggcctgatgctgaaggacaccgacatcaccaacctgaagatcgacaccctgcccgacgacatgctggagctgatccacaacgtggactacctgaagctgatcctggagatcaacatcaccatcttcggcttcatcctgatcatcatcctgttcatgctgctgatgttctacagataccagcacatcttcatcagcatctacgtgatcgactgcaaggagtgcaacatgtaccacagcaagagcggcctgagatacaacggcgacttcaccaacaagtgcatgacctgcacctgcggcgaggtggacgacatggagggcctgaacaagcacaagaagagatacaactgcctgatcaagtacaagaccaccatcctgcagcacttcttcctgagcatcctggtgtgcctgatcctgaaggagagcgtgctgttcgccgccgcccagagcgaggagatcatcaagtgcctggagcaggagagcctgaccagcaagtgcaccggccccctgctgaagaccccccagtgcaccgagcagcagaagaacctgctgttcatcgagatcgccaagcagatggagaaggacaacatcatcaccagcctggacaacgccctgatcgccaagctgcccaacgagatcgccggcagcatggccatcctggacaccaagaagtactaccacgagcagatcaccctggagtacgccatcctgagcaagtactgcgactactacaagaagtacgagggcaacaccggctacagccagaccacctggagaacctacctgagaagccaggacctggagatctgcctgatcctgccctaccagttcttctgcagatgcttcaagagcggcaccggctgcatcgacaccaagatggagatcaagagcaccatggacacctactacagcagccaccagaccaagttcgacagcgacctgaactacatgctgcacgtgatccacctggccttcagaggcagcgccaccagctacatcgccaagtgcctgatcgagaagaactacaccgagaccatcagctacctgaccaagatccaggagaagtaccccaacaaccagctgctgaaggtggccatcttcttcaccaaccacctgctgaaccagagcctggtggagaacttcgaggtgagcaccgagtggagcagatacaagcacagcaccgcccagcccgagcacgagtggaagaagggcagcgagctgaagatgctggaccccaacaagctgaagaccggccccgccatccagacctgcctgcacatcaaggacctgcactgcatcagccccagaagcagagcccccaccagcggcatcatcacctgcggcctgaacgaccaggcctgcgtgtacagaaagcccgacaagaagatctacgccagccacatgacccagcacggcttctgcgtgatggacggccactgcctgaagcccttcgagcccatcagcggcgagatgctgcagatcatcaagaagagcaagtgctggaccgaggacatcgaggacctgatcaccgagggccaggacaagggcagaatcagctgccagcccatcgacgtgggcaactgcaacgtgagcggcaacctgtggaccatcaccctgtgcagcgacaagaagttctactacaccgacaacaagcacgtgcacgacaacagcaaggacatcggctactactgcatggaggagaactgcaagatccccagattccccatccaccccgacttcgtgaaggactgcgagtgggacctgaaccacatcaagatcgaccacctgaagcagatcaacatcgaggacatcaacagctacaagaagatcctgaccgagaagctgaccaccgccctgaacagcttcaagtacaagggcaacgagaacctgccccacagcatccccaagtacaagtacatcaccatccagggcacccagaccatcgacggcatcgagaacgccttcatcgaggtggagatccccgccctgagcggcagcgccaccggcttcaagatcagcagcagagacggcatcgagctgttcgacgccatcctgtacgtgaagcaggccagcttcagcagcgtgtacaagaagctgtacgtgaccggccccaccatcggcatcaacaccaagcacgacgagagatgcaccggcgcctgccccatgaccctgccccacagctacggctggctgaccttcagcaaggagagaaccagccagtggggctgcgaggagtacggctgcctggccatcagcgacggctgcgtgttcggcagctgccaggacatcatcaaggacgacctgaccatctacagaaaggagaccgaggagctgagcctggccgagatctgcatcaccttcatgcacaacaccttctgcaccagcatcgacagcaccacccccaccatcaccgacatcctggaggcccagttcaagaccgtggagagcttcaagctgcccaacaccgtgggcctgaagatgcacaagctgtacatcggcaccatcaacgacatcggcgtgtacaagaaggcctgcggcaacgtgcagaagtacaacaacaccatcctgggcagcggcagccccaagttcgactacgtgtgccacctggccaagagaaaggacgtgatcctgagaaagtgcttcgacaacgactacaacagctgcaagctgctgaaggtggccaacgacctgagaatcgaggaggacggcgagaagctgaaggtgatcaactacaagaaggtgatgggcaccctgaagttcaaggccatcttcggcgacatcaagtacaagagcttcacccaggacgtggacatcgacgccgaggccacctgcgtgggctgcctgaactgcttcgagaacatcaactgcgagatcaaggtgcagagccccctggagaccacctgcgaggtggagagcagctgcgacctgttcaccaccagaatcctgttccaccaggacatccacaagtacgccctgaagctgatctgcagcaaggaggccagcagcaagttctggatcagattctgcaacaaggagatcaagagcagcatcagcctgatcaacgccgcccccatcctggagctggcccccatcgaccagaccagctacgtgaaggaggaggacgagagatgcggcacctggatgtgcagagtggcccaggagggcatcggcgtgatcttcgagcccttcaagaacctgttcggcagctacctgggcatcttctacatcatcatcatcgtgatcatcctgctggtgctgttcgtgtacatcttcctgcccatgatcctgaagctgaaggagatcctgcagaagaacgaggtggcctaccagagagacatgaagatcagatga

SEQ ID NO: 9297 - RNA, 4344 nt, synthetic construct
  misc_feature 1..4344: note = derived and/or modified CDS sequence (opt4) from BWAV(UgAr1888)__KJ867186.1__GP
  source 1..4344: mol_type = other RNA
atggccatcttcaagctgatcgtgctgctggccttcagctacgccaccggcgtgccccaggagctgagcagatgcttcaccggcggcagcgtggtgagacagcactggagcaagaacgccatcagcgagctgtgcctgaaggacgacgtgagcatcatcaagagcgagatcgagtacaagaagaacgagaccggcaccttcgccctgaacaagatctacagaaagtggatcaccaccgactgggagaagtgccagccccagaagagcaccggcggccacatcagcgtgctggaggtgagacacgacctgaccctggccagcgccacctacatctgcggcaacccctgcaccatcaacgtggacagagagatggcccaggtgcacctgcagaccgagggcgtgaaccacttcgagatcagcggcaccaccatcaagagcggctggttcaagaccaccacctacatcaccctggaccagacctgcgagcacctgaaggtgagctgcggcaagcagagcgtgcagttccacgcctgcttcaagcagcacatggcctgcgtgagattcctgcacagaaccatcctgcccggcaacatggccaacagcatctgccagaacatcgagatcatcatcctgctggccctgaccctgagcatcttcatcctgctgtgcatcctgaccaagacctacatctgctacatcctgctgcccatcttcatccccatcagctacatctacggctacttctacaacagaagctgcaagaagtgcagccagtgcggcctggtgtaccaccccttcaccgagtgcggcagaaactgcgtgtgcggcgccagatacgacaccagcgagagaatgaagctgcacagactgagcggcctgtgccccggctacaagagcctgaagaccgccagagtgctgtgcaagagcaagggcagcgccagcatcctgagcatcctgatcagcctgctgatcctgaccttcgtgacccccatcaacggcctgatgctgaaggacaccgacatcaccaacctgaagatcgacaccctgcccgacgacatgctggagctgatccacaacgtggactacctgaagctgatcctggagatcaacatcatgatcttcggcttcatcctgatcatcatcctgttcatgctgctgatgttctacagataccagcacatcttcatcagcatctacgtgatcgactgcaaggagtgcgacatgtaccacagcaagagcggcctgagatacaacggcgacttcaccaacaagtgcatgacctgcacctgcggcgaggtggacgacatggagggcctgaacaagcacaagaagagatacaactgcctgatcaagtacaagaccaccatcctgcagcacttcagcctgagcatgctggtgtgcctgatcctgaaggagagcgtgctgttcgccgccgcccagcccgaggagatcatcaagtgcctggagcaggagagcctgaccagcgagtgcaccggccccctgctgaagaccccccagtgcaccgagcagcagaagaacctgctgttcatggagatcgccaagcagatggagaaggacaacgtgatcaccagcctggacaacgccctgatcgccaagctgcccaacgagatcgccggcagcatggccatcctggacaccaagaagtactaccacgagcagatcaccctggagtacgccatcctgagcaagtactgcgactactacaagaagtacgagggcaacaccggctacagccagaccacctggagaacctacctgagaagccaggacctggagatctgcctgatcctgccctaccagttcttctgcagatgcttcaagagcggcaccggctgcatcgacaccaagatcgagttcaagagcaccatggacacctactacagcagccaccagaccaagttcgacagcgacctgaactacatgctgcacgtgatccacctggccttcagaggcagcgccaccagctacatcgccaagtgcctgatcgagaagaactacaccgagaccatcagctacctgaccaagatccaggagaagtaccccaacaaccagctgctgaaggtggccatcttcttcaccaaccacctgctgaaccagagcctggtggagaacttcgaggtgagcaccgagtggagcagatacaagcacagcgccacccagcccgagcacgagtggaagaagggcagcgagctgaagatcctggacagcaacaagctgaagaccggccccgccatccagacctgcctgcacatcaaggacctgcactgcatcagccccagaagcagagcccccaccagcggcatcatcacctgcggcctgaacgaccaggcctgcgtgtacagaaagcccaacaaggagatctacgccagccacatgacccagcacggcttctgcatcatggacggccactgcctgaagcccttcgagcccatcagcggcgagatgctgcagatcatcaagaagagcaagtgctggaccgaggacatcgaggacctgatcaccgagggccaggacaagggcagaatcagctgccagcccatcgacgtgggcaactgcaacgtgagcggcaacctgtggaccatcaccctgtgcagcgacaagaagttctactacaccgacaacaagcacgtgcacgacagcagcaaggacgtgggctactactgcatggaggagaactgcaagatccccagattccccatccaccccgacttcgtgaaggactgcgagtgggacctgaaccacatggagatcgaccacctgaagcagatcaacatcgaggacatcaacagctacaagaagatcctgaccgagaagctgatcaccgccctgaacagcttcaagtacaagggcaacgagaacctgccccacagcatccccaagtacgagtacatcaccatccagggcacccagaccatcgacggcatcgagaacgccttcatcgaggtggagatccccgccctgagcggcagcgccaccggcttcaagatcagcagcagagacggcatcgagctgttcgacgccatcctgtacgtgaagcaggccagcttcagcagcgtgtacaagaagctgtacgtgaccggccccaccatcggcatcaacaccaagcacgacgagagatgcaccggcgcctgccccgtgaccctgccccacagctacggctggctgaccttcagcaaggagagaaccagccagtggggctgcgaggagtacggctgcctggccatcagcgacggctgcgtgttcggcagctgccaggacatcatcaaggacgacctgaccgtgtacagaaaggagaccgaggagctgagcctggccgagatctgcatcaccttcatgcacaacaccttctgcaccagcatcgacagcaccacccccaccatcaccgacatcctggaggcccagttcaagaccgtggagagcttcaagctgcccaacaccgtgggcctgaagatgcacaagctgtacatcggcaccatcaacgacatcggcgtgtacaagaaggcctgcggcaacgtgcagaagtacaacaacaccatcctgggcagcggcagccccaagttcgactacgtgtgccacctggccaagagaaaggacgtgatcctgagaaagtgcttcgacaacgactacaacagctgcaagctgctgaaggtggccaacgacctgagaatcgaggaggacggcgagaagctgaaggtgatcaactacaagaaggtgatgggcaccctgaagttcaaggccatcttcggcgacgtgaagtacaagagcttcacccaggacgtggacatcgacgccgaggccacctgcgtgggctgcctgaactgcttcgagaacatcaactgcgagatcaaggtgcagagccccctggagaccacctgcgaggtggagagcagctgcgacctgttcaccaccagaatcctgttccaccaggacatccacaagtacgccctgaagctgatctgcagcaaggaggccaccagcaagttctggatcagattctgcaagaaggagatcaagagcagcatcagcctgatcaacgccgcccccatcctggagctggcccccatcgaccagaccagctacgtgaaggaggaggacgagagatgcggcacctggatgtgcagagtggcccaggagggcatcggcgtgatcttcgagcccttcaagaacctgttcggcagctacctgggcatcttctacatcatcatcatcgtgatcatcctgctggtgctgttcgtgtacatcttcctgcccatgatcctgaagctgaaggagatcctgcagaagaacgaggtggcctaccagagagacatgaaggtgagatga

SEQ ID NO: 9298 - RNA, 4332 nt, synthetic construct
  misc_feature 1..4332: note = derived and/or modified CDS sequence (opt4) from BWAV/PGAV(SAAr1)__KJ867177.1__GP
  source 1..4332: mol_type = other RNA
atgatctgcatctgcatcttcgtggccatcttccccgccatctacgccatccccgacagctacagcagatgcttcaccggcggcaccgtggtgaaggagatgtggagcaaggacgccgtgaccgagctgtgcatcaaggacgacgtgagcatcgtgaagaccgagaccagctacaagaagaacggcaccggcaccttcgccctgaacaaggtgaccagaaagtggctgatgaccgactgggagaagtgcaagccccagaagagcagcagcggccacatcaacgtgatcgaggtgagagacgacctgaccctggccaccagcacctacatctgcagcagcagctgcaccatcaacgtggacagagagaccgcccagatccagctgaacaccgacagcatcaaccacttcgagatcgccggcaccaccatcaagaccggctggttcaagagcaccaccctggtggccctggaccagacctgcgagcacctgaaggtgagctgcggcaagcagagcgtgcagttccacgcctgcttcaaccagcacatgagctgcgtgagattcctgcacagaaccatcctgcccggcaacatggccaagagcatctgccagaacatcgagatcatcatcctggtgggcctgatcatcctgatcttcctgctgctgtgcatcctgaccaagacctacatctgctacatcctgctgcccatcttcatccccctgagctacgcctacggctacttctacaacaaggcctgcaagaagtgcagccagtgcggcctggtgtaccaccccttcaccgagtgcggcagcaactgcgtgtgcggcgccagatacgacaccagcgagagaatgaagctgcacagaatcagcggcctgtgccccggctacaagagcctgagaaccgccagagtgctgtgcaagagcaagggcagcgccagcatcctgagcatcctgatcagcatcctgatcctgatgttcgtgacccccatcaacggctacatgatcaccaacgagttcgacgagggcaagctgaccgtggacagcctgcccgacgacatgctgagcatgatcagcagactgagcgccctgcagttcatcttcaccctgaacatcgcctgcagcgtgctggtgaccctgctgacctgcctgttcctgatcatcttctacagattccagcacagattcctgagcaagtacgccatcaactgcaccgagtgcgacatgtaccaccagaagaagggcctgatctacaacggcgacttcaccaacaagtgcatgacctgcacctgcggcgaggtgaacgacatggagggcctgaacaagcacaagaagagatacaactgcctgatcaagtacaaggccgcctggttcctgaacctgaccatcaccatcatctgcctgatgctgatcaaggacggcagcatgatggccgccgccgagaccaacatcgagacctgcatggccaagcccagcctgaccaccgactgcaccggccccttcctgaagatcaccaagtgcgacgagagccagaaggccctgcccttccaggagatcgccaagcagctggtgaagagcaacgtgctgaccctgctggacaagcacatcgtggagaagctgcccaacgagatcgccggcagcctgagcatcctggacaagaagcagcactaccacgagcagctggccgtggagtacggcatcctgagcaagtactgcgactactacgagctgtacaagagcaacagcggctacagccagagcacctggggcacctacctgagaagccacgacttcgagatctgcctgctgctgccctaccagtacgtgtgcagatgcttcaagagcggcaccggctgcaccgacaccaagttcgagttcgagcagaagatgaacgagacctacaacagcaagaacgacatgtacaacagcgacttcaccctggccctgaccgtgctgcacctggccatgagaggcaccgccagcacctacatcatcgacaacgtgctgcagaagaactacagcaacgtgatcgagtacctgaacaccaccaagaacaacttcaagagcaaccaggtgttcggcgtgctggtggacttcaccatctacctgctgagacacgccagctacgccaagtacaacctgccccagagcctgaagaagttcagaagcgtgagcagcgacctgaccaccatcagcggcagaagcagcggccagaacatcgtgagcgacctgcaccagggcgacgtgatcaagacctgcctgaacatcaagcagctgaactgcatcagccccaagagcagaaccaccaccaccaacctgatcacctgcggcagcagccagatcagcgtgtacaacctgcccagaggccagctgtacgagagcgtgaccaccgagcacggcacctgcgccggcgacggccactgcctgaccgacttcatgcccatcaacagcgacttcctggccaccctgaagaagagcaagtgctggaccaccgacatccccaacatcatcaagctggtggagagcgacggcaagatcagctgccagcccatcgacgtgggcagctgcaacgtgagcggcaacatctggaccatcaccaagtgcagcgacaacaagtactactacaccgacaacaagcacgtgcacgacgacgagaaggacatcggccactactgcatggaggagacctgcaagttcgtgagattccccatcaacgacaagttcgtgagcaactgcgagtgggacctgaaccacatcgagatcaacaagctgaaccaggtggagctggacaacatcaacgcctacaagaaggtgctgaccgagaagctgaccagcagcctgagcgtgttcaagtacaagctgacccagaacctgccccacgtgatccccaagttcaagtacatcaccatccagggcacccagaccgtggacggcatcgagaacagcttcatcgaggtggagatccccgccctgagcggcgccgccagcggcttcaagatcatgaccaaggagaacaacgagctgttcgacgccatcctgtacgtgaagcaggccagcttcagcagcatctacaagaagatctacaccaccggccccaccatcggcatcaacaccaagcacgacgagaagtgcaccggcgcctgccccgtgaacctgccccacagcaccggctggctgaccttcgccaaggagagaaccagcacctggggctgcgaggagtacggctgcctggccatcaacgacggctgcgtgttcggcagctgccaggacatcatcaaggacgagatgtacatcttcaagaaggagaccgaggaggtggccctggtggagatctgcatcagcttcaaccacaagaccttctgcaccgacgtggacagcaccacccccatcatcaccgacaccctggaggcccagttcaagaccgtggagagctacaagctgcccaaccacgtggccctgaagcagcacaagctgtacgtgggccagatcaacgacttcggcgtgtacaagaaggcctgcggcaacgtgcagaagatcaacaacaccatctacggcgagggcacccccagattcgactacctgtgccacctggccaagagaaaggacgtgctggtgagaaagtgcttcgacaacgactacaacagctgcagcctgctgaccatcgccgacgacctgagactggaggaggacggcgagaagctgaaggtgatcaactacagaaaggtgctgggcagcatgaagttcaaggccctgttcggcgacatcagatacaagagcttcaccgaggacatcgagctggacgtggaggccagctgcgccggctgcatcaactgcttcgacaacatccactgcgagatcaagctgaccaacggcctggacaccagctgcagcttcgagagcagctgcgacgccttcaacagcagaatcctgttcaacagcaaccagcacgtgtacagcaccaagctgatctgcaccaaggagcagaccaaggccttcgagatcaagatctgcggcaagaccatcaaggccgacctggtggtgaccgaggccaagcccatcctggagctgacccccatcgaccagaccagctacatcaaggaggaggacaccagatgcggcacctggttctgcagactgaccaaggagggcttcagcgtgctgctggagcccttcaagaacctgttcggcagctacctgggcatcgcctacaccatcatcatcgccctgctgtgcctgttcgtgttcatctacatcatcctgcccatgatcatgaagctgaaggaggtgctgaagcagaacgagatcgcctaccagaaggagcagaagaagagatga

SEQ ID NO: 9299 - RNA, 4332 nt, synthetic construct
  misc_feature 1..4332: note = derived and/or modified CDS sequence (opt4) from BWAV/PGAV(191B-07)__KJ867180.1__GP
  source 1..4332: mol_type = other RNA
atgatctacatctacatcttcgtggccatcttccccgccatctacgccatccccgacagctacagcagatgcttcaccggcggcaccgtggtgaaggagatgtggagcaaggacgccgtgaccgagctgtgcatcaaggacgacgtgagcatcgtgaagaccgagaccagctacaagaagaacggcaccggcaccttcgccctgaacaaggtgaccagaaagtggctgatgaccgactgggagaagtgcaagccccagaagagcagcagcggccacatcaacgtgatcgaggtgagagacgacctgaccctggccaccagcacctacatctgcagcagcagctgcaccatcaacgtggacagagagaccgcccagatccagctgaacaccgacagcatcaaccacttcgagatcgccggcaccaccatcaagaccggctggttcaagagcaccaccctggtggccctggaccagacctgcgagcacctgaaggtgagctgcggcaagcagagcgtgcagttccacgcctgcttcaaccagcacatgagctgcgtgagattcctgcacagaaccatcctgcccggcaacatggccaagagcatctgccagaacatcgagatcatcatcctggtgggcctgaccatcctgatcttcctgctgctgtgcatcctgaccaagacctacatctgctacatcctgctgcccatcttcatccccctgagctacgcctacggctacttctacaacaaggcctgcaagaagtgcagccagtgcggcctggtgtaccaccccttcaccgagtgcggcagcaactgcgtgtgcggcgccagatacgacaccagcgagagaatgaagctgcacagaatcagcggcctgtgccccggctacaagagcctgagaaccgccagagtgctgtgcaagagcaagggcagcgccagcatcctgagcatcctgatcagcatcctgatcctgatgttcgtgacccccatcaacggctacatgatcaccaacgagttcgacgagggcaagctgaccgtggacagcctgcccgacgacatgctgagcatgatcagcagactgagcgccctgcagttcatcttcaccctgaacatcgcctgcagcgtgctggtgaccctgctgacctgcctgttcctgatcatcttctacagattccagcacagattcctgagcaagtacgccatcaactgcaccgagtgcgacatgtaccaccagaagaagggcctgatctacaacggcgacttcaccaacaagtgcatgacctgcacctgcggcgaggtggacgacatggagggcctgaacaagcacaagaagagatacaactgcctgatcaagtacaaggccgcctggttcctgaacctgaccatcaccatcatctgcctgatgctgatcaaggacggcagcatgatggccgccgccgagagcaacatcgagacctgcatggccaagcccagcctgaccaccgactgcaccggccccttcctgaagatcaccaagtgcgacgagagccagaaggccctgcccttccaggagatcgccaagcagctggtgaagagcaacgtgctgaccctgctggacaagcacatcgtggagaagctgcccaacgagatcgccggcagcctgagcatcctggacaagaagcagcactaccacgagcagctggccgtggagtacggcatcctgagcaagtactgcgactactacgagctgtacaagagcaacagcggctacagccagagcacctggagaacctacctgagaagccacgacttcgagatctgcctgctgctgccctaccagtacgtgtgcagatgcttcaagagcggcaccggctgcaccgacaccaagttcgagttcgagcagaagatgaacgagacctacaacagcaagaacgacatgtacaacagcgacttcaccctggccctgaccgtgctgcacctggccatgagaggcaccgccagcacctacatcatcgacaacgtgctgcagaagaactacagcaacgtgatcgagtacctgaacaccaccaagaacaacttcaagagcaaccaggtgttcggcgtgctggtggacttcaccatctacctgctgagacacgccagctacgccaagtacaacctgccccagagcctgaagaagttcagaagcgtgagcagcgacctgaccaccatcagcggcagaagcagcggccagaacatcgtgagcgacctgcaccagggcgacgtgatcaagacctgcctgaacatcaagcagctgaactgcatcagccccagaagcagaaccaccaccaccaacctgatcacctgcggcaccagccagatcagcgtgtacaacctgcccagaggccagctgtacgagagcgtgaccaccgagcacggcacctgcgccgacgacggccactgcctgaccgacttcatgcccatcaacagcgacttcctggccaccctgaagaagagcaagtgctggaccaccgacatccccaacatcatcaagctggtggagagcgacggcaagatcagctgccagcccatcgacgtgggcagctgcaacgtgagcggcaacatctggaccatcaccaagtgcagcgacaacaagtactactacaccgacaacaagcacgtgcacgacgacgccaaggacatcggccactactgcatggaggagacctgcaagttcgtgagattccccatcaacgacaagttcgtgagcaactgcgagtgggacctgaaccacatcgagatcaacaagctgaaccaggtggagctggacaacatcaacgcctacaagaaggtgctgaccgagaagctgaccagcagcctgagcgtgttcaagtacaagctgacccagaacctgccccacgtgatccccaagttcaagtacatcaccatccagggcacccagaccgtggacggcatcgagaacagcttcatcgaggtggagatccccgccctgagcggcgccgccagcggcttcaagatcatgaccaaggagaacaacgagctgttcgacgccatcctgtacgtgaagcaggccagcttcagcagcatctacaagaagatctacaccaccggccccaccatcggcatcaacaccaagcacgacgagaagtgcaccggcgcctgccccgtgaacctgccccacaacaccggctggctgaccttcgccaaggagagaaccagcacctggggctgcgaggagtacggctgcctggccatcaacgacggctgcgtgttcggcagctgccaggacatcatcaaggacgagatgtacatcttcaagaaggagaccgaggaggtggccctggtggagatctgcatcagcttcaaccacaagaccttctgcaccgacgtggacagcaccacccccatcatcaccgacaccctggaggcccagttcaagaccgtggagagctacaagctgcccaaccacgtggccctgaagcagcacaagctgtacgtgggccagatcaacgacttcggcgtgtacaagaaggcctgcggcaacgtgcagaagatcaacaacaccatctacggcgagggcacccccagattcgactacctgtgccacctggccaagagaaaggacgtgctggtgagaaagtgcttcgacaacgactacaacagctgcagcctgctgaccatcgccgacgacctgagactggaggaggacagcgagaagctgaaggtgatcaactacagaaaggtgctgggcagcatgaagttcaaggccctgttcggcgacatcagatacaagagcttcaccgaggacatcgagctggacgtggaggccagctgcgccggctgcatcaactgcttcgacaacatccactgcgagatcaagctgaccaacggcctggacaccagctgcagcttcgagagcagctgcgacgccttcaacagcagaatcctgttcaacagcaaccagcacgtgtacagcaccaagctgatctgcaccaaggagcagaccaaggccttcgagatcaagatctgcggcaagaccatcaaggccgacctggtggtgaccgaggccaagcccatcctggagctgacccccatcgaccagaccagctacatcaaggaggaggacaccagatgcggcacctggttctgcagactgaccaaggagggcttcagcgtgctgctggagcccttcaagaacctgttcggcagctacctgggcatcgcctacaccgtgatcatcgccctgctgtgcctgttcgtgttcatctacatcatcctgcccatgatcatgaagctgaaggaggtgctgaagcagaacgagatcgcctaccagaaggagcagaagaagagatga

SEQ ID NO: 9300 - RNA, 4326 nt, synthetic construct
  misc_feature 1..4326: note = derived and/or modified CDS sequence (opt4) from CEV(283)__KX817313.1__GP
  source 1..4326: mol_type = other RNA
atgatcttcatgctgatcctgttcgccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacaccaagaacagcaccggcgtgttcagcaacaacgtggccatcagaaagtggctggtgagcgactggcacgactgcagacccagaaaggtggtgggcggccacatcaacgtgatcgaggtgggcgacgacctgaccctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcagcctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacgtggagatcatcatcctggtgaccctggccctgctgatcttcatcctgctgagcatcatcagcaagacctacatctgctacctgctgatgcccatcttcatccccatcgcctacatctacggcctgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatgatggtgggcgagagcaaggagaccttcgagctggaggagctgcccgacgacatgctggagatggccaacaacctgaacacctactacatgctgtgcgtggccaactacgccgtgacctggagcctgctgatcgtggccctgatcatcggcctgctgttcaagaagtaccagcacagattcctggacatctacgccatgtactgcgaggagtgcgacatgtaccacgacagaagcggcatcaagtggaacggcgacttcaccaacaagtgcggccactgcacctgcggccagtacgaggacgccagcggcctgctggtgcacagaaagacctacaactgcctgatccagtacaagagcaagtggatcatgaacttcctggtgacctacgtgatcctggtgctgctgaaggacagcgtggtgatcgtgcaggccaagggcgtggacttcagcgagtgcatcgaggccgagaaggtgagatggaactgcaccggccccttcgtgaacctgggcaactgcgagaagaagcagaagaaggagccctacagcaacatcgccgcccagctgaagggcctgggcgccatcagcatcctggacgtgcccatcatcgccagcatccccgaggacatcgccggcgccctgagatacatcgaggaccagagaagctaccacagccagctgaccgtggagtacgccatgctgaccagatactgcgactactacacccagttcagcgacaacagcggctacagccagaccacctggagagtgtacctgagaagccacgacttcgaggcctgcgtgctgtaccccaaccagcacttctgcagatgcgtgaagcacggcgacaagtgcagcagcagcaactgggacttcgccagcgagatgaagaactactacagcggcaagcagagcaagttcgacaaggacctgaacctggccctgaccagcctgcaccacgccttcagaggcaccagcagcagctacatcgccggcctgctgagcagcaaggccaacgacgagctggtgcagtacaccagcaagatcagagagaagttccccggcaacgccctgctgaaggccgtgatcgactacatcgcctacatgaagggcctgaccgagatgagcaacttcaagaaggacgagttctgggacgagctggtgtacgtgcccgaccccaccaagccccccaagctgagcagaagcagcggcaccgtgtacgacttcaagagcgccaccagcaacctgggcgagaagaactgcaaggacgtgaagggcgtggtgtgcctgagccccagaagcggcgtgacctacgacagcatcatcgcctgcggcgagggcagcagccccaacatctacagaatccccaagaccggcgtgtaccagagcaacagcgagcccagcaactactgcgtgagcgacagccactgcctggaggacttcgaggtgatcaaccaggaggagctggacgccatcaagaagagcagatgctgggaggtggactacctgtacgccaaccccagcaagcagagcgacggcatcagaagctgcagaatgagagacgccggccactgcaacgtgaccaccaacagatggcccatcatccagtgcgacgacaacaagtactactacagcgagctgcagagagactacgacaaggagcaggacatcggccacttctgcctgagccccagatgcaccaccgtgagattccccatccaccccaagcacgtgagcaactgcgactggcaggtgagccacagcaccgtggacaaggtggacgtgcacaacctggaggacatcgagcagtacagaaaggccatcacccagaagctgcagaacagcctgagcatcttcaagtacgccagaaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacaccaaggagggcaagcacctgctggacgtgatcgcctacgtgaagcaggccagctacagcagcctgtacaacaagatgtacgtgaccggccccaccgtgggcatcaacaccaagcacgacgagctgtgcaccggcccctgccccgtgaacgtgccccacagcgacggctggctgaccttcgccagagagagaaccagcagctggggctgcgaggagttcggctgcctggccatcagcgacggctgcgtgttcggcagctgccaggacctgatcaaggaggagctggccgtgtacagaaaggagaccgaggaggccaccaacgtggagctgtgcctgaccttcagcgacaagacctactgcaccgagctgaaccccatcacccccatcatcaccaacctgttcgaggtgcagttcaagaccgtggagacctacagcctgcccagagtggtggccgtgcagaaccacgagatcagaatcggccagatcaacgacctgggcatctacagcaagggctgcggcaacgtgcagaaggtgaacaacaccatctacggcaacggcgtgcccaagttcgactacctgtgccacctggccagcagaaaggaggtgatcgtgagaaagtgcttcgacaacgacttccaggcctgcaagttcctgcagagcccccccagctacagactggaggaggacgacggcagcatcaccgtgatcgactacaagaagatcctgggcaccatcaagatgaaggccatcctgggcgacgtgaagtacaagaccttcgccgagaacatcgacatcaccgccgagggcgtgtgcaccggctgcgtgaactgcttcgagaacatccactgcgagctgaccatccacaccaccatcgaggccagctgccccgtgaccagcccctgcaccctgttccacgacagaatcctgatcacccccgacgagcacaagtacgccatgaaggtgatctgcaccgagaagcagaccggcaccctgcccttcaagatctgcaacagcaaggtggacgccaccctgaccctggtggaggccaagcccatcctggagctggccagcgtggaccagaccgcctacatcagagagaaggacgagagatgcaagacctggatgtgcagagtgagagacgagggcatccaggtgatcctggagcccttcaagaacctgttcggcagctacatcggcatcttctacaccagcatcctgatcgtgatcaccatcttcatcatcatctacgtgatcctgcccatctgcttcaagctgaaggacaccctgcagaagcacgaggacgcctacaagagagagatgaagatcagatga

SEQ ID NO: 9301 - RNA, 4326 nt, synthetic construct
  misc_feature 1..4326: note = derived and/or modified CDS sequence (opt4) from CEV(BFS283)__AF123483.1__GP
  source 1..4326: mol_type = other RNA
atgatcttcatcctgatcctgttcgccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacaccaagaacagcaccggcgtgttcagcaacaacgtggccatcagaaagtggctggtgagcgactggcacgactgcagacccagaaaggtggtgggcggccacatcaacgtgatcgaggtgggcgacgacctgaccctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcagcctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacgtggagatcatcatcctggtgaccctggccctgctgatcttcatcctgctgagcatcatcagcaagacctacatctgctacctgctgatgcccatcttcatccccatcgcctacatctacggcctgatctacaacaagagctgcaagaagtgcaagctgtgcggcctggtgtaccaccccatcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatgatggtgggcggcagcaaggagaccttcgagctggaggagctgcccgacgacatgctggagatggccaacaacctgaacacctactacatgctgtgcgtgaccaactacgccgtgacctggagcctgctgatcatcgccctggccatcggcctgctgttcaagagataccagcacagattcctggacatctacgccatgtactgcgaggagtgcgacatgtaccacgacagaagcggcatcaagtggaacggcgacttcaccaacaagtgcggccagtgcacctgcggccagtacgaggacgccagcggcctgctggtgcacagaaagacctacaactgcctgatccagtacaagagcaagtggatcatgaacttcctgatcacctacgtgatcctggtgctgctgaaggacagcgtggtgatcgtgcaggccaagggcaccgacttcagcgagtgcatcgacgccgacaagatcaagtggaactgcaccggccccttcgtgaacctgggcaactgcgagaagaagcagaagaaggagccctacagcaacatcgccgcccagctgaagggcctgagcgccatcagcatcctggacgtgcccatcatcgccagcatccccgaggacatcgccggcgccctgagatacatcgaggaccagagaagctaccacagccagctgaccgtggagtacgccatgctgaccagatactgcgactactacacccagttcagcgacaacagcggctacagccagaccacctggagagtgtacctgagaagccacgtgttcgaggcctgcatcctgtaccccaaccagcacttctgcagatgcgtgaagcacggcgacaagtgcagcagcagcaactgggacttcgccagcgagatgaagaactactacagcggcaagcagaacaagttcaacaaggacctgaacctggccctgaccagcctgcaccacgccttcagaggcaccagcagcagctacatcgccggcctgctgagcaccaaggccaacgacgagctggtgcagtacaccagcaagatcagagagaagttccccggcaacgccctgctgaaggccatcatcgactacatcgcctacatgaagggcctgaccgagatgagcaacttcaagaaggacgagttctgggacgagctggtgtacgtgcccgaccccaccaagccccccaagctgagcagaggcagcgagaccgtgtacgacttcaagagcgccaccagcaacctgggcgagaagaactgcaaggacgtgaagggcgtggtgtgcctgagccccagaagcggcgtgacctacgacagcatcatcgcctgcggcgagggcagcagccccaacatctacaagatccccaagaccggcgtgtaccagagcaacagcgagcccagcaactactgcgtgagcgacagccactgcctggaggacttcgaggtgatcagccaggaggagctggacgccatcaagaagagcagatgctgggaggtggactacctgtacgccaacccccccaagcagagcgacggcgtgagaagctgcagaatgaaggacgccggccactgcaacgtgaccaccaacagatggcccatcatccagtgcgacgacaacaagtactactacagcgagctgcagagagactacgacaaggagcaggacatcggccacttctgcctgagccccagatgcgccaccgtgagattccccatccaccccaagcacatcagcaactgcgactggcaggtgagccacagcaccgtggacaaggtgaacgtgcacaacctggaggacatcgagcagtacagaaaggccatcacccagaagctgcagaacagcctgagcatcttcaagtacgccagaaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacaccaaggagggcaagcacctgctggacgtgatcgcctacgtgaagcaggccagctacagcagcctgtacaacaagatgtacgtgaccggccccaccgtgggcatcaacaccaagcacgacgagctgtgcaccggcccctgccccgtgaacgtgccccacagcgacggctggctgaccttcgccagagagagaaccagcagctggggctgcgaggagttcggctgcctggccatcagcgacggctgcgtgttcggcagctgccaggacctgatcaaggaggagctgaccgtgtacagaaaggagaccgaggaggccaccaacgtggagctgtgcctgaccttcgccgacaagacctactgcaccgagctgaaccccgtgacccccatcatcaccaacctgttcgaggtgcagttcaagaccgtggagacctacagcctgcccagagtggtggccgtgcagaaccacgagatcagaatcggccagatcaacgacctgggcgtgtacagcaagggctgcggcaacgtgcagaaggtgaacaacaccatctacggcaacggcgtgcccaagttcgactacctgtgccacctggccagcagaaaggaggtgatcgtgagaaagtgcttcgacaacgacttccaggcctgcaagttcctgcagagcccccccagctacagactggaggaggacgacggcagcatcaccgtgatcgactacaagaagatcctgggcaccatcaagatgaaggccatcctgggcgacgtgaagtacaagaccttcgccgagaacatcgacatcaccgccgagggcgtgtgcaccggctgcatcaactgcttcgagaacatccactgcgagctgaccatccacaccaccatcgaggccagctgccccgtgaccagcccctgcaccctgttccacgacagaatcctgatcacccccgacgagcacaagtacgccatcaaggtgatctgcaccgagaagcagaccggcaccctgcccttcaagatctgcaacagcaagatcgacgccaccctgaccctggtggaggccaagcccatcctggagctggcccccgtggaccagaccgcctacatcagagagaaggacgagagatgcaagacctggatgtacagagtgagagacgagggcatccaggtgatcctggagcccttcaagaacctgttcggcagctacatcggcatcttctacaccagcatcctggtggtgatcgccatgttcatcatcgtgtacgtgatcctgcccatctgcttcaagctgaaggacaccctgcagagacacgaggacgcctacaagagagagatgaagatcagatga

SEQ ID NO: 9302 - RNA, 4329 nt, synthetic construct
  misc_feature 1..4329: note = derived and/or modified CDS sequence (opt4) from CHATV(Mohko ILO8-3)__KF719222.1__GP
  source 1..4329: mol_type = other RNA
atgatgatcttcatcctgatcctgttcgccgtgagcgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcatctacagcaacaacgtggccatcagaaagtggctggtgagcgactggcacgactgcagacccagaaaggtgagcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcatcctgagcatcatcaccgccatcctggtgctgaccttcgtgacccccatcaacagcatggtgatcggcgagagcaaggaggtgttcgagctggaggagctgcccgacgacatgctggagatggccctgaagatcaacctgtactacttcgtgtgcgtgatcaactacgccgtgacctggagcctggtgatcgtggccctgctgatcgccctgatcttcaagaagtaccagcacagattcctgaacctgtacgccatgtactgcgaggagtgcgacatgtaccacgacagaatcggcctgaagagaaacggcgacttcaccaacaagtgcagacagtgcacctgcggccagtacgaggacgccaccggcctgatgacccacagaaagacctacaactgcctggtgcagtacaagagcaagtggatcctgaacttcctgatcacctacatgatcctgaccctgatcaaggacagcgccatcatcgtgcaggccgccggcaccgacttcagcgcctgcctggaggcccagagcgtggactggaactgcaccggccccttcctgaacctgggcaactgccagaagcagcagaagaaggagagctacgccaacatcgccacccagctgaagggcctgcaggccatcagcgtgctggacgtgcccatgatcgccaacatccccgaggacatcgccggcgccctgagatacatcgaggagaaggacaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcagcagcagcaactgggacttcgccaacgagatgaagaactactacagcggcaagcagaacaagttcgacaaggacctgaacctggccctgatggccgtgcaccacgccttcagaggcaccagcagcgcctacatcgccaccatgctgagcaagaagagcaacaacgacctggtgacctacaccaacaagatcaaggagaagttccccggcaacgccctgctgaaggccatcatggactacatcagctacatgaagggcctgagcgagatgaccaacttcaagtacgacgagttctgggacgacctgctgcacaagcccagccccaccaacgccccccccctgagcagagacagcgagcccagctacaacttcaagagcgtgatcagcagcagaagcgtgaagagctgcaagaacgtgaagaacgtggtgtgcctgagccccagaagcggcgtgagctacgacagcatcctggcctgcggcgagcccaacggccccagcgtgtacaagaagcccagcgacggcgtgttccagagcaacagcgacaagaccatgtactgcctggccgacagccactgcctggaggacttcgaggtggtgagccaggaggagctggacgccatcaagaagagcaagtgctgggtgaccgagtaccccaacgtgaagctgagcaagctgagcgacggcatcaccagctgcagaatgaaggacagcggcaagtgcaacgtggccgccaacagatggcccatcatccagtgcgagaacgacaagttctactacagcgagctgcagaacgactacgacaagacccaggacatcggccacttctgcctgagccccggctgcagcaccatcagattccccatcaaccagaagcacatcagcaactgcaactggcaggtgagcagaagcagcatcgccaagatcgacgtgcacgacatcgaggacatcgaccagtacagaaaggccatcacccagaagctgcagaccggcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacagcaaggagggcaagcacctgctggacatcgtgggctacgtgaagagcgccagctacagcagcgtgtacaccaagctgtacagcaccggccccaccagcggcatcaacaccaagcacgacgagctgtgcaccggcccctgccccgtgaacatcaaccaccagaccggctggctgaccttcgccaaggagagaaccagcagctggggctgcgaggagttcggctgcctggccatcagcgacggctgcgtgttcggcagctgccaggacatcgtgagagacgagctgagcgtgtacagaaaggagaccgaggaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgaggtgaagatcggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagagcagcggcaccgtgaccgtgatcgactacaagaagatcctgggcaccatcaagatgaaggccatcctgggcgacgtgaagtacaagaccttcgccgacaacgtggacatgaccgccgagggcagctgcgccggctgcatcaactgcttcgagaacatccactgcgagctgaccctgcacaccaccatcgacgccagctgccccgtgaccagcccctgcaccgtgttccacgacagaatcctgatcacccccaacgagcacaagtacgccatgaaggtgatctgcaccgagaagcccggcaacaccctgaccatcaagatctgcggcaccaagatcgacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatctgcatcatcgtgctgctgatcgtgatctacatcgtgctgcccatctgcttcaagctgagagacaccctgagacagcacgaggacgcctacaagagagagatgaagatcagatga

SEQ ID NO: 9303 - RNA, 4329 nt, synthetic construct
  misc_feature 1..4329: note = derived and/or modified CDS sequence (opt4) from CHATV(Mohko M07-1)__KF719225.1__GP
  source 1..4329: mol_type = other RNA
atgatgatcttcatcctgatcctgttcgccgtgagcgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcatctacagcaacaacgtggccatcagaaagtggctggtgagcgactggcacgactgcagacccagaaaggtgagcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacatgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcatcctgagcatcatcaccgccatcctggtgctgaccttcgtgacccccatcaacagcatggtgatcggcgagagcaaggaggtgttcgagctggaggagctgcccgacgacatgctggagatggccctgaagatcaacctgtactacttcgtgtgcgtgatcaactacgccgtgacctggagcctgatcatcgtggccctgctgatcgccctgatcttcaagaagtaccagcacagattcctgaacctgtacgccatgtactgcgaggagtgcgacatgtaccacgacagaatcggcctgaagagaaacggcgacttcaccaacaagtgcagacagtgcacctgcggccagtacgaggacgccaccggcctgatgacccacagaaagacctacaactgcctggtgcagtacaagagcaagtggatcctgaacttcctgatcacctacatggtgctgaccctgatcaaggacagcgccatcatcgtgcaggccgccggcaccgacttcagcgcctgcctggaggcccagagcgtggactggaactgcaccggccccttcctgaacctgggcaactgccagaagcagcagaagaaggagagctacgccaacatcgccacccagctgaagggcctgcaggccatcagcgtgctggacgtgcccatgatcgccaacatccccgaggacatcgccggcgccctgagatacatcgaggagaaggacaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcggcagcagcaacagagacttcgccaacgagatgaagaactactacagcggcaagcagaacaagttcgacaaggacctgaacctggccctgatggccgtgcaccacgccttcagaggcaccagcagcgcctacatcgccaccatgctgagcaagaagagcaacaacgacctggtgacctacaccaacaagatcaaggagaagttccccggcaacgccctgctgaaggccatcatggactacatcagctacatgaagggcctgagcgagatgaccaacttcaagtacgacgagttctgggacgacctgctgcacaagcccagccccaccaacgccccccccctgagcagagacagcgagcccagctacaacttcaagagcgtgatcagcagcagaagcgtgaagagctgcaagaacgtgaagaacgtggtgtgcctgagccccagaagcggcgtgagctacgacagcatcctggcctgcggcgagcccaacggccccagcgtgtacaagaagcccagcgacggcatcttccagagcaacagcgacaagaccatgtactgcctggccgacagccactgcctggaggacttcgaggtggtgagccaggaggagctggacgccatcaagaagagcaagtgctgggtgaccgagtaccccaacgtgaagctgagcaagctgagcgacggcatcaccagctgcagaatgaaggacagcggcaagtgcaacgtggccgccaacagatggcccatcatccagtgcgagaacgacaagttctactacagcgagctgcagaacgactacgacaagacccaggacatcggccacttctgcctgagccccggctgcagcaccatcagattccccatcaaccagaagcacatcagcaactgcaactggcaggtgagcagaagcagcatcgccaagatcgacgtgcacgacatcgaggacatcgaccagtacagaaaggccatcacccagaagctgcagaccggcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacagcaaggagggcaagcacctgctggacatcgtgggctacgtgaagagcgccagctacagcagcgtgtacaccaagctgtacagcaccggccccaccagcggcatcaacaccaagcacgacgagctgtgcaccggcccctgccccgtgaacatcaaccaccagaccggctggctgaccttcgccaaggagagaaccagcagctggggctgcgaggagttcggctgcctggccatcagcgacggctgcgtgttcggcagctgccaggacatcgtgagagacgagctgagcgtgtacagaaaggagaccgaggaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgaggtgaagatcggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagaacagcggcaccgtgaccgtgatcgactacaagaagatcctgggcaccatcaagatgaaggccatcctgggcgacgtgaagtacaagaccttcgccgacaacgtggacatgaccgccgagggcagctgcgccggctgcatcaactgcttcgagaacatccactgcgagctgaccctgcacaccaccatcgacgccagctgccccgtgaccagcccctgcaccgtgttccacgacagaatcctgatcacccccaacgagcacaagtacgccatgaaggtgatctgcaccgagaagcccggcaacaccctgaccatcaagatctgcggcaccaagatcgacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatctgcatgatcgtgctgctgatcgtgatctacatcgtgctgcccatctgcttcaagctgagagacaccctgagacagcacgaggacgcctacaagagagagatgaagatcagatga

SEQ ID NO: 9304 - RNA, 4329 nt, synthetic construct
  misc_feature 1..4329: note = derived and/or modified CDS sequence (opt4) from CHATV(Mohko M07-2-83)__KF719228.1__GP
  source 1..4329: mol_type = other RNA
atgatgatcttcatcctgatcctgttcgccgtgagcgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcatctacagcaacaacgtggccatcagaaagtggctggtgagcgactggcacgactgcagacccagaaaggtgagcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacatgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcatcctgagcatcatcaccgccatcctggtgctgaccttcgtgacccccatcaacagcatggtgatcggcgagagcaaggaggtgttcgagctggaggagctgcccgacgacatgctggagatggccctgaagatcaacctgtactacttcgtgtgcgtgatcaactacgccgtgacctggagcctgatcatcgtggccctgctgatcgccctgatcttcaagaagtaccagcacagattcctgaacctgtacgccatgtactgcgaggagtgcgacatgtaccacgacagaatcggcctgaagagaaacggcgacttcaccaacaagtgcagacagtgcacctgcggccagtacgaggacgccaccggcctgatgacccacagaaagacctacaactgcctggtgcagtacaagagcaagtggatcctgaacttcctgatcacctacatggtgctgaccctgatcaaggacagcgccatcatcgtgcaggccgccggcaccgacttcagcgcctgcctggaggcccagagcgtggactggaactgcaccggccccttcctgaacctgggcaactgccagaagcagcagaagaaggagagctacgccaacatcgccacccagctgaagggcctgcaggccatcagcgtgctggacgtgcccatgatcgccaacatccccgaggacatcgccggcgccctgagatacatcgaggagaaggacaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcggcagcagcaactgggacttcgccaacgagatgaagaactactacagcggcaagcagaacaagttcgacaaggacctgaacctggccctgatggccgtgcaccacgccttcagaggcaccagcagcgcctacatcgccaccatgctgagcaagaagagcaacaacgacctggtgacctacaccaacaagatcaaggagaagttccccggcaacgccctgctgaaggccatcatggactacatcagctacatgaagggcctgagcgagatgaccaacttcaagtacgacgagttctgggacgacctgctgcacaagcccagccccaccaacgccccccccctgagcagagacagcgagcccagctacaacttcaagagcgtgatcagcagcagaagcgtgaagagctgcaagaacgtgaagaacgtggtgtgcctgagccccagaagcggcgtgagctacgacagcatcctggcctgcggcgagcccaacggccccagcgtgtacaagaagcccagcgacggcatcttccagagcaacagcgacaagaccatgtactgcctggccgacagccactgcctggaggacttcgaggtggtgagccaggaggagctggacgccatcaagaagagcaagtgctgggtgaccgagtaccccaacgtgaagctgagcaagctgagcgacggcatcaccagctgcagaatgaaggacagcggcaagtgcaacgtggccgccaacagatggcccatcatccagtgcgagaacgacaagttctactacagcgagctgcagaacgactacgacaagacccaggacatcggccacttctgcctgagccccggctgcagcaccatcagattccccatcaaccagaagcacatcagcaactgcaactggcaggtgagcagaagcagcatcgccaagatcgacgtgcacgacatcgaggacatcgaccagtacagaaaggccatcacccagaagctgcagaccggcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacagcaaggagggcaagcacctgctggacatcgtgggctacgtgaagagcgccagctacagcagcgtgtacaccaagctgtacagcaccggccccaccagcggcatcaacaccaagcacgacgagctgtgcaccggcccctgccccgtgaacatcaaccaccagaccggctggctgaccttcgccaaggagagaaccagcagctggggctgcgaggagttcggctgcctggccatcagcgacggctgcgtgttcggcagctgccaggacatcgtgagagacgagctgagcgtgtacagaaaggagaccgaggaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgaggtgaagatcggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagaacagcggcaccgtgaccgtgatcgactacaagaagatcctgggcaccatcaagatgaaggccatcctgggcgacgtgaagtacaagaccttcgccgacaacgtggacatgaccgccgagggcagctgcgccggctgcatcaactgcttcgagaacatccactgcgagctgaccctgcacaccaccatcgacgccagctgccccgtgaccagcccctgcaccgtgttccacgacagaatcctgatcacccccaacgagcacaagtacgccatgaaggtgatctgcaccgagaagcccggcaacaccctgaccatcaagatctgcggcaccaagatcgacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatctgcatgatcgtgctgctgatcgtgatctacatcgtgctgcccatctgcttcaagctgagagacaccctgagacagcacgaggacgcctacaagagagagatgaagatcagatga

SEQ ID NO: 9305 - RNA, 4326 nt, synthetic construct
  misc_feature 1..4326: note = derived and/or modified CDS sequence (opt4) from CHATV(LEIV-15854)__HQ734820.1__GP
  source 1..4326: mol_type = other RNA
atgatcttcatcctgatcctgttcgccgtgagcgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcatctacagcaacaacgtggccatcagaaagtggctggtgagcgactggcacgactgcagacccagaaaggtgagcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcatcctgagcatcatcaccgccatcctggtgctgaccttcgtgacccccatcaacagcatggtgatcggcgagagcaaggaggtgttcgagctggaggagctgcccgacgacatgctggagatggccctgaagatcaacctgtactacttcgtgtgcgtgatgaactacgccgtgacctggagcctggtgatcgtggccctgctgatcgccctgatcttcaagaagtaccagcacagattcctgaacctgtacgccatgtactgcgaggagtgcgacatgtaccacgacagaatcggcctgaagagaaacggcgacttcaccaacaagtgcagacagtgcacctgcggccagtacgaggacgccaccggcctgatgacccacagaaagacctacaactgcctggtgcagtacaagagcaagtggatcctgaacttcctgatcacctacatggtgctgaccctgatcaaggacagcgccatcatcgtgcaggccgccggcaccgacttcagcgcctgcctggaggcccagagcgtggactggaactgcaccggccccttcctgaacctgggcaactgccagaagcagcagaagaaggagagctacgccaacatcgccacccagctgaagggcctgcaggccatcagcgtgctggacgtgcccatgatcgccaacatccccgaggacatcgccggcgccctgagatacatcgaggagaaggacaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcagcagcagcaactgggacttcgccaacgagatgaagaactactacagcggcaagcagaacaagttcgacaaggacctgaacctggccctgatggccgtgcaccacgccttcagaggcaccagcagcgcctacatcgccaccatgctgagcaagaagctgaacaacgacctgatcacctacaccaacaagatcaaggagaagttccccggcaacgccctgctgaaggccatcatggactacatcagctacatgaagggcctgagcgagatgaccaacttcaagtacgacgagttctgggacgacctgctgcacaagcccagccccaccaacgccccccccctgagcagagacagcgagcccagctacaacttcaagagcgtgatcagcagcagaagcgtgaagagctgcaagaacgtgaagaacgtggtgtgcctgagccccagaagcggcgccagctacgacagcatcctggcctgcggcgagcccaacggccccagcgtgtacaagaagcccagcgacggcgtgttccagagcaacagcgacaagaccatgtactgcctggccgacagccactgcctggaggacttcgaggtggtgagccaggaggagctggacgccatcaagaagagcaagtgctgggtgaccgagtaccccaacgtgaagctgagcaagctgagcgacggcatcaccagctgcagaatgaaggacagcggcaagtgcaacgtggccgccaacagatggcccatcatccagtgcgagaacgacaagttctactacagcgagctgcagaacgactacgacaagacccaggacatcggccacttctgcctgagccccggctgcagcaccatcagattccccatcaaccagaagcacatcagcaactgcaactggcaggtgagcagaagcagcatcgccaagatcgacgtgcacgacatcgaggacatcgaccagtacagaaaggccatcacccagaagctgcagaccggcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacagcaaggagggcaagcacctgctggacatcgtgggctacgtgaagagcgccagctacagcagcgtgtacaccaagctgtacagcaccggccccaccagcggcatcaacaccaagcacgacgagctgtgcaccggcccctgccccgtgaacatcaaccaccagaccggctggctgaccttcgccaaggagagaaccagcagctggggctgcgaggagttcggctgcctggccatcagcgacggctgcgtgttcggcagctgccaggacatcgtgagagacgagctgagcgtgtacagaaaggagaccgaggaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccgtgcagaaccacgaggtgaagatcggccagatcaacgacctgggcatctacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagaacagcggcaccgtgaccgtgatcgactacaagaagatcctgggcaccatcaagatgaaggccatcctgggcgacgtgaagtacaagaccttcgccgacaacgtggacatgaccgccgagggcagctgcgccggctgcatcaactgcttcgagaacatccactgcgagctgaccctgcacaccaccatcgacgccagctgccccgtgaccagcccctgcaccgtgttccacgacagaatcctgatcacccccaacgagcacaagtacgccatgaaggtgatctgcaccgagaagcccggcaacaccctgaccatcaagatctgcagcaccaagatcgacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatctgcgtgatcgtgctgctgatcgtgatctacatcgtgctgcccatctgcttcaagctgagagacaccctgagacagcacgaggacgcctacaagagagagatgaagatcagatga

SEQ ID NO: 9306 - RNA, 4326 nt, synthetic construct
  misc_feature 1..4326: note = derived and/or modified CDS sequence (opt4) from CHATV(LEIV-17756)__EU621834.1__GP
  source 1..4326: mol_type = other RNA
atgatcttcatcctgatcctgttcgccgtgagcaccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcaccttcagcaacaacgtggccatcagaaagtggatcgtgagcgactggcacgactgcagacccaagaaggtgagcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcatcctgagcatcatcaccgccatcctggtgctgaccttcgtgacccccatcaacagcatggtggtgggcgagagcaaggaggtgttcgagctggaggagctgcccgacgacatgctggagatggccctgaagatcaacttctactacttcgtgtgcgtgatgaactacgccgtgacctggggcctgatcgtggtggccctgctgatcggcctgatcttcaagaagtaccagcacagattcctgaacctgtacgccatgtactgcgaggagtgcgacatgtaccacgacagaaccggcctgaagagaaacggcgacttcaccaacaagtgcagacagtgcacctgcggccagtacgaggacgccaccggcctgatgacccacagaaagacctacaactgcctggtgcagtacaagagcaagtggatcctgaacttcctgatcacctacatggtgctgaccctgatcaaggacagcgccatcgtggtgcaggccaccggcaccgacttcagcagctgcctggagacccagagcgtgaactggaactgcaccggccccttcctgaacctgggcaactgccagaagcagcagaagaaggagagctacgccaacatcgccacccagctgaagggcctgcaggccatcagcgtgctggacatgcccatgatcgccagcatccccgaggacatcgccggcgccctgagatacatcgaggagagagagaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcagcagcagcaactgggacttcgccaacgagatgaagaactactacagcggcaagcagaacaagttcgacaaggacctgaacctggccctgatgaccatgcaccacgccttcagaggcaccagcagcgcctacatcgccgccctgctgagcaagagaagcaacgacgacctggtggcctacaccaacaagatcaaggagaagttccccggcaacgccctgctgaaggccgtgatggactacatcagctacatgaagagcctgagcgagatgagcaacttcaagtacgacgagttctgggacgacctgctgcacaagcccaaccccaccaaggcccccagcctgagcagaggcgacgagcccgcctacaacttcaagctggccatcagcagcagaagcatgaagagctgcaagaacgtgaagagcgtggtgtgcctgagccccagaagcggcgtgagctacgacagcatcctggcctgcggcgagcccaacgcccccagcgtgcacagaaagcccagcgacggcgtgttccagagcaacagcgacaagaccatgtactgcctggccgacagccactgcctggaggacttcgaggtggtgagccaggaggagctggacgccatcaagaagagcgagtgctgggtgaccgagtaccccaacgtgaagctgagcaagctgagcgacggcatcaagagctgcagaatgaaggacagcggcaagtgcaacgtggccaccaacagatggcccatcatccagtgcgagaacgacaagttctactacagcgagctgcagaacgactacgacaagacccaggacatcggccacttctgcctgagccccggctgcagcaccatcagattccccatcaaccagaagcacatcagcaactgcaactggcaggtgagcagaagcagcatcgccaagatcgacgtgcacaacatcgaggacatcgagcagtacagaaaggccatcacccagaagctgcagaccagcctgagcctgttcaagtacgccagaaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacagcaaggagggcaagcacctgctggacgtgatcggctacgtgaagagcgccagctacagcagcgtgtacaccaagctgtacagcaccggccccaccagcggcatcaacaccaagcacgacgagctgtgcaccggcccctgccccgccaacatcaagcaccagaccggctggctgaccttcgccagagagagaaccagcagctggggctgcgaggagttcggctgcctggccatcagcgacggctgcgtgttcggcagctgccaggacatcgtgagagacgagctgagcgtgtacagaaaggagaccgaggaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgagatcaagatcggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagaacagcggcaccgtgaccgtgatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccatccacaccaccatcgacgccagctgccccgtgaccagcccctgcaccgtgttccacgacagaatcctggtgacccccaacgagcacaagtacgccatgaaggtgatctgcaccgagaagcccggcagcaccctggccatcaagatctgcaacaccaagatcgacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcgtgatcagcatcatcgccctgctgatcgtgatctacatcatcctgcccatctgcttcaagctgagagacaccctgagaaagcacgaggacgcctacaagagagagatgaagatcagatga

SEQ ID NO: 9307 - RNA, 4326 nt, synthetic construct
  misc_feature 1..4326: note = derived and/or modified CDS sequence (opt4) from CHATV(LEIV-18733)__HQ734821.1__GP
  source 1..4326: mol_type = other RNA
atgatcttcatcctggtgctgctggccgtgagcaccgccagccccgtgtaccagagatgcttccaggacggcgccatcgtgaagcagaaccccagcaaggaggccgtgaccgaggtgtgcctgaaggacgacgtgagcatgatcaagaccgaggccagatacatgaagaacgccaccggcaccttcagcaacaacgtggccatcagaaagtggctggtgagcgactggcacgactgcagacccaagaaggtgagcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccgtgctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcatcctgagcatcatcaccgccatcctggtgctgaccttcgtgacccccatcaacagcatggtgatcggcgagagcaaggaggtgttcgagctggaggagctgcccgacgacatgctggagatggccctgaagatcaacttctactacttcgtgtgcgtgatcaactacgccgtgacctggggcctgatcgtggtggccctgctgatcggcctggtgttcaagaagtaccagcacagattcctgaacctgtacgccatgtactgcgaggagtgcgacatgtaccacgacagaaccggcctgaagagaaacggcgacttcaccaacaagtgcagacagtgcacctgcggccagtacgaggacgccaccggcctgatcacccacagaaagacctacaactgcctggtgaagtacaagagcaagtggatcctgaacttcctgatcacctacatggtgctgaccctgatcaaggacagcgccatcgtggtgcaggccgccggcaccgacttcagcgcctgcctggaggcccagagcgtggactggaactgcaccggccccttcctgaacctgggcaactgccagaagcagcagaagaaggagagctacgccaacatcgccacccagctgaagggcctgcaggccatcagcgtgctggacatgcccatgatcgccagcatccccgaggacatcgccggcgccctgagatacatcgaggagaaggagaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgaccgtgcaccacgccttcagaggcaccagcagcgcctacatcgccaccatgctgagcaagaagagcaacaacgacctggtggcctacaccaacaagatcaaggagaagttccccggcaacgccctgctgaaggccgtgatggactacatcagctacatgaagagcctgagcgagatgaccaacttcaagtacgacgagttctgggacgacctgctgtacagacccaaccccaccaaggcccccagcctgagcagagagagcgagaccagctacaacttcaagctggtgatcagccccaagagcatgaagagctgcaagaacgtgaagagcgtggtgtgcctgagccccagaagcggcgccagctacgacagcatcctggcctgcggcgagcccaacggccccagcgtgtacagaaagcccagcggcggcgtgttccagagcaacagcgacaagaccatgtactgcctggccgacagccactgcctggaggacttcgaggtgatcggccaggaggagctggacgccatcaagaagagcgtgtgctgggccgtggagtaccccgacgtgaccctgagcaagctgagcgacggcgtgaagagctgcagaatgaaggacagcggcaagtgcaacgtggccgccaacagatggcccatcatccagtgcgagaacgacaagttctactacagcgagctgcagaacgactacgacaagacccaggacatcggccacttctgcctgagccccggctgcagcaccgtgagattccccatcaaccagaagcacatcagcaactgcaactggcaggtgagcagaagcagcatcgccaagatcgacgtgcacgacatcgaggacatcgaccagtacagaaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcgtgggcttcaagatcaacagcaaggagggcaagcacctgctggacatcatcggctacgtgaagagcgccagctacagcagcgtgtacaccaagctgtacagcaccggccccaccagcggcatcaacaccaagcacgacgagctgtgcaccggcccctgccccgccaacatcaaccaccagaacggctggctgaccttcgccaaggagagaaccagcagctggggctgcgaggagttcggctgcctggccatcagcgacggctgcgtgttcggcagctgccaggacatcgtgagagacgagctgagcgtgtacagaaaggagaccgaggaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgagatcaagatcggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagaacagcggcaccatcaccgtgatcgactacaagaagatcctgggcaccatcaagatgaaggccatcctgggcgacgtgaagtacaagaccttcgccgacaacgtggacatcaccgtggagggcagctgcgccggctgcatcaactgcttcgagaacatccactgcgagctgaccatccacaccaccatcgaggccagctgccccgtgaccagcccctgcaccgtgttccacgacagaatcctgatcacccccaacgagcacaagtacgccatgaaggtggtgtgcaccgagaagcccggcaacaccctgaccctgaaggtgtgcaacaccaaggtggacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccatcatcatcagcatcatcgtgctgctgatcgtgatctacatcatcctgcccgtgtgcttcaagctgagagacaccctgagacagcacgaggacgcctacaagagagagatgaaggtgagatga

SEQ ID NO: 9308 - RNA, 4326 nt, synthetic construct
  misc_feature 1..4326: note = derived and/or modified CDS sequence (opt4) from CHATV(LEIV-22712)__HQ734822.1__GP
  source 1..4326: mol_type = other RNA
atgatcttcatcctgatcctgttcgccgtgagcgccgccagccccgtgtaccagagatgcttccaggacggcgccatcgtgaagcagaaccccagcaaggaggccgtgaccgaggtgtgcctgaaggacgacgtgagcatgatcaagaccgaggccagatacaccaagaacgccaccggcaccttcagcaacaacgtggccatcagaaagtggctggtgagcgactggcacgactgcagacccaagaaggtgagcggcggccacatcaacgtgatcgaggtgggcgacgacctgagcctgcacaccgagagctacgtgtgcagcgccgactgcaccatcggcgtggacaaggagaccgcccagatcagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccgtgctgcccggcagcatcgccaacagcatctgccagaacatcgagatcatcatcctggtgaccctgaccctgctgatcttcgtgctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagaagcagcggcctgtgccccggctacaagagcctgagagccgccagagtgatgtgcaagagcaagggccccgccagcgtgctgagcatcatcaccgccatcctggtgctgaccttcgtgacccccatcaacagcatggtggtgggcgagagcaaggaggtgttcgagctggaggagctgcccgacgacatgctggagatggccctgaagatcaacttctactacttcatctgcgtgatgaactacgccgtgacctggggcctgatcgtggtgggcctgctgatcggcctggtgttcaagaagtaccagcacagattcctgaacctgtacgccatgtactgcgaggagtgcgacatgtaccacgacagaaccggcctgaagagaaacggcgacttcaccaacaagtgcagacagtgcacctgcggccagtacgaggacgccaccggcctgatcacccacagaaagacctacaactgcctggtgcagtacaagagcaagtggatcctgaacttcctgatcgcctacatgaccctgaccctgatcaaggacagcgccatcatcgtgcaggccaccggcaccgacttcatcagctgcctggagacccagagcgtgaactggaactgcaccggccccttcctgaacctgggcaactgccagaagcagcagaagaaggagccctacgccaacatcgccacccagctgaagggcctgcaggccatcagcgtgctggacatccccatgatcgccaacatccccgaggacatcgccggcgccctgagatacatcgaggagaaggagaccttccacgtgcagctgaccgccgagtacgccatgctgaccagatactgcgactactacacccagttcgccgacaacagcggctacagccagaccacctggagagtgtacctgagaagccacgacttcgacgcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgaccatgcaccacgccttcagaggcaccagcagcgcctacatcgccaccctgctgagcaagaagctgaacgacgacctggccgcctacaccaacaagatcaaggagaagttccccggcaacgccctgctgaaggccatgatggactacatcagctacatgaagagcctgagcgagatggccaacttcaagtacgacgagttctgggacgacctgctgcacaagcccgaccccaccaaggcccccctgctgagcagaggcagcgagcccgtgtacaacttcaagctggtggtgagcagcagaagcgtgaagagctgcaagaacgtgaagagcgtggtgtgcctgagccccagaagcggcgtgagctacgacagcgtgctggcctgcggcgagcccaacggccccagcgtgtacagaaagcccagcgacggcgtgttccagagcaacagcgacaagaccatctactgcctggccgacagccactgcctggaggacttcgaggtgatcagccaggaggagctggacgccatcaagaagagcgagtgctgggtgatcgagtaccccaacgtgaagctgaccaagcccagcgacggcatcaagagctgcagaatgaaggacagcggcaagtgcaacgtggccaccaacagatggcccatcatccagtgcgagaacaacaacttctactacagcgagctgcagaacgactacgacaagacccaggacatcggccacttctgcctgagccccggctgcagcaccatcagataccccatcaaccagaagcacatcagcaactgcaactggcaggtgagccacagcagcatcgccaagatcgacgtgcacaacatcgaggacatcgagcagtacagaaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaacagcaaggagggcaagcacctgctggacgtgatcggctacgtgaagagcgccagctacagcagcgtgtacagcaagctgtacagcaccggccccaccagcggcatcaacaccaagcacgacgagctgtgcaccggcccctgccccgagaacatcaagcaccagaccggctggctgaccttcgccagagagagaaccagcagctggggctgcgaggagttcggctgcctggccatcagcgacggctgcgtgttcggcagctgccaggacatcgtgaaggacgagctgagcgtgtacagaaaggagaccgaggaggtgaccgacgtggagctgtgcctgaccttcagcgacaagacctactgcaccaacctgaaccccatcacccccatcatcaccaacctgttcgaggtgcagttcaagaccgtggagacctacagcctgcccagaatcgtggccatccagaaccacgagatcaagatcggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagacccccgccagctacagactggaggagaacagcggcgccatcaccgtgatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccatccacaccaccatcgaggccagctgccccgtgaccagcccctgcaccgtgttccacgacagaatcctggtgacccccaacgagcacaagtacgccatgaaggtggtgtgcaccgagaagcccggcagcaccctggtgatcaaggtgtgcaacaccaagatcgacgccagcctggccctgatcgacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgtgctgctgatcgtgatctacatcatcctgcccatctgcttcaagctgagagacaccctgagaaagcacgaggacgcctacaagagagagatgaagatcagatga

SEQ ID NO: 9309 - RNA, 4332 nt, synthetic construct
  misc_feature 1..4332: note = derived and/or modified CDS sequence (opt4) from INKV(KN3641)__U88059.1__GP
  source 1..4332: mol_type = other RNA
atggaggtgctgaacctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacatcaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgaccatcgtgagcaagacctacgtgtgctacctgctgatgcccatcttcatccccatcgcctacatctacggctggatctacaacaagagctgcaagaagtgcagactgtgcggcctggtgtaccaccccttcaccgagtgcggcacccactgcgtgtgcggcgccagatacgagaccagcgacagaatgaagctgcacagagccagcggcctgtgccccggctacaagaacctgagagccgccagagtgatgtgcaagagcaagggccccgccagcgtgctgagcatcatgaccgccgtgctgatcctgaccttcgtgacccccatcagcgccatggtgatcggcgagagcagcgaggtgtacaccctgggcgacctgcccgacgacatggtggagatggccgagagagtgaacatctactaccagatcatcatcatcaactacagcatcacctgggtgttcctgctgctgggcctgatcatcgcctacttcttcagaaagtaccagcacagattcctgagcttctacgccatgtactgcaaggagtgcgacatgtaccacgagagagccggcctgacctactggggcgacttcaccaacaagtgcagacagtgcacctgcggccagttcgaggacgtgaccggcctgatggtgcacaagaagagctacaactgcatcatcaagtacaaggccaagtggatcagagacatgctgatcacctacctgctgatcatgctgatcaaggacagcctgctgttcgtgggcgccaccggcaccgacttcgccgcctgcatcgacgagaagaccgtgacctggaacagaaccggccccttcctgaacctgggcagatgcgacaagagccagaagaagaccggctacaccgacatcgccgaccagctgaagggcctgggcgccatcagcgtgctggacatccccatgatcaagaagatgcccgacgagatcagcggcagcctgaagtgcatcgacgacctggagacccaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagcacggcgacaagtgcaacagcgccaagtgggacttcgccaacgagatgaagaccttctacaccggccagaaggccaagttcaacaaggacctgaacctggccctgctggtgctgcacaaggccttcagaggcaccggcaccagctacatcgccgagagcatggccagaaaggacaacagaagcatgacccacttcgccctggagatcaagaagaagttccccaccaacgccctgctgaccgccctgatcgactacatcagctacctgcagagccccgccgagatgagcaccttcgagctggacgaggactgggaggacttcaagtacaagcccgagcccaccgagagcccccagctgagaagccacagaaccgaccagtacaacttcaagaacgccgacagcaacagcaacgtgaaggtgtgcaagaacatccagaaggtgagctgcatcagccccagaagcagagccaagttcgagaacatcatcgcctgcggcgagcacgccaaccccagcgtgtacaccatgcccaacgtgagcatctaccagagcaacagcgagagaagccactactgcatcgccgacagccactgcctggaggagtacgaggtggtggagaccgagctgctgaacgccctgaagaagagcaagtgctgggccagagagatggacgacatcgtgctgcacaagcaggtggacggcctgagaagctgcagaatgaaggacaccggcaactgcaacgtgcaggagaacgactggaccatcgtgctgtgcgagaacggcaactactactacagcgaggcccacagagactacgacaaggaccaggacgtgggccacttctgcctgagccccagatgcagcaccatcagataccccatcagcaagagacacatcaagaactgcgactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcgtggagaccgtggagggcatcgagaacgccttcatcgagagcgagatccccgccctggccggcaccgccatcggcttcaagatcaacagcagagagggcaactacctgatggacgtgatcggctacgtgaagagcggcagctacagcgccacctacaccaagctgtacatcaccggccccaccatcggcgtgaacaccaagcacgacgagaagtgcaccggcccctgccccgccatcatcgaccacaaggagggctggctgaccttcgccaagggcagaaccagcacctggggctgcgaggagttcggctgcctggccgtgagcgacggctgcgtgttcggcagctgccaggacatcatcaaggacgagctggccgtgcacagaaagaccaccgaggagcccaccaccgtggagctgtgcctgaccttcagcgacaagacctactgcaccaacctgaacgccatcacccccatcatcaccgacaagttcgaggtgcagttcaagaccgtggagagctacaccctgcccagaatcatcgccatcaagaaccacgagatcaaggtgggccagatcaacgacctgggcgtgtacagcaagggctgcggcaacgtgcagaagatcaacggcaccaactacggcaacggcctgcccaagttcgactacctgtgccacctggccggcagaaaggaggtgatcatcagaaagtgcttcgacaacgactaccaggcctgcaagttcctgcagagcccccccagctacagactggaggagcaccagggcaccgtgaccgtgatcgactacaagaagatcctgggcaccatcaagatggaggccatcctgggcgacgtgaagtacagaaactaccagagcaacatcgagatcaacgccaagggcacctgcgccggctgcatcaactgcttcgagaacatccactgcgagttcaccatccacaccaccgtggaggccagctgccccatcgtgaccgactgggtgagcttccacgacagaatcctgatcacccccgacgagcacaagtacgccctgaaggtggtgtgccaggagaagcccaagctgagcctgaagttcaagatctgcaacaccaacatcgacgccagcatgaccgtggtggacagcaagcccatcctggagctggcccccgtggaccagaccacctacatcagagagagagacgagagatgcaagacctggatgtgcagagtgagagacgagggcttccaggtgatcctggagcccttcaagaacctgttcggcagctacatcggcatcttctacaccggcatcctgtgcatcgtgtgcctgctgatcgtgatctacatcatcctgcccatctgcttcaagctgagagacaccctgagacagctggaggacgcctacaagaaggaggtgaagatcagatga

SEQ ID NO: 9310 - RNA, 4332 nt, synthetic construct
  misc_feature 1..4332: note = derived and/or modified CDS sequence (opt4) from INKV(SWAR83-161)__U88060.1__GP
  source 1..4332: mol_type = other RNA
atggaggtgctgaacctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacatcaagaacgccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggccatcttcatcttcctgaccatcgtgagcaagacctacgtgtgctacctgctgatgcccatcttcatccccatcgcctacatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagaacctgagagccgccagagtgatgtgcaagagcaagggccccgccagcgtgctgagcatcatgaccgccatcctgatcctgaccttcgtgacccccatcagcgccatggtgatcggcgagagcagcgaggtgtacaccctggacgagctgcccgacgacatggtgcagatggccgagagagtgaacatctactaccagatcatcatcatcaactacagcatcacctgggccttcctgctgttcggcctggtgctggcctacttcttcaagaagtaccagcacagattcctgagcttctacgccatgtactgcaaggagtgcgacatgtaccacgagagagccggcctgacctactggggcgacttcaccaacaagtgcagacagtgcacctgcggccagttcgaggacgtgaccggcctgatggtgcacaagaagagctacaactgcatcatcaagtacaaggccaagtggatcagagacatcctgatcacctacctgatcatcatgctgatcaaggacagcctgctgttcgtgggcgccaccggcaccgacttcgccgcctgcatcgacgagaagaccgtgacctggaactgcaccggccccttcctgaacctgggcaagtgcgacaagagccagaagaagatcggctacgccgacatcgccgaccagctgaagggcctgggcgccatcagcgtgctggacatccccatgatcaagagaatgcccgacgagatcagcggcagcctgaagtacatcgacggcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagcacggcgacaagtgcaacagcgccaagtgggacttcgccaacgagatgaagaccttctacaccggccagaaggccaagttcaacaaggacctgaacctggccctgctggtgctgcacaaggccttcagaggcaccggcaccagctacatcgccgagagcatggccagaaaggacaacagaagcatgacccacttcgccctggagatcaagaagaagttccccaccaacgccctgctgaccgccctgatcgactacatcagctacctgcagagcctggccgagatgagcaccttcgagctggacgaggactgggaggacttcaagtacaagcccgagcccaccgaggccccccagctgagaagccacagaaccgaccagtacaacttcaagaacgccgacagcaacagcaacgtgaaggtgtgcaagaacatccagaaggtgagctgcatcagccccagaagcagagccaagttcgagaacatcatcgcctgcggcgagcacgccaaccccagcgtgtacatgatgcccaacgtgagcatctaccagagcaacagcgagagaagccactactgcatcgccgacagccactgcctggaggagtacgaggtggtggagagcgagctgctgaacgccctgaagaagagcaagtgctgggccaaggagatggacgacatcgtgctgcacaagcagagcgacggcctgagaagctgcagaatgaaggacaccggcaactgcaacgtgcaggagaacgactggaccatcgtgctgtgcgagaacggcaactactactacagcgaggcccacagagactacgacaaggaccaggacgtgggccacttctgcctgagccccagatgcagcaccatcagataccccatcaacaagagacacatcagaaactgcgactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcatcgagaccgtggagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcgtgaacaccaagcacgacgagaagtgcaccggcccctgcccccccatcatcgaccacaaggagggctggctgaccttcgccaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagaatcatcgccatcaagaaccacgagatcaaggtgggccagatcaacgacctgggcgtgtacagcaagggctgcggcaacgtgcagaagatcaacggcaccaactacggcaacggcgtgcccaagttcgactacctgtgccacctggccagcagaaaggaggtgatcatcagaaagtgcttcgacaacgactaccaggcctgcaagttcctgcagagcccccccagctacagactggaggagcaccagggcaccgtgaccgtgatcgactacaagaagatcctgggcatcatcaagatgaaggccatcctgggcgacgtgaagtacaagaactaccagagcaacatcgagatcaacgccgagggcacctgcgccggctgcatcaactgcttcgagaacatccactgcgagttcaccatccacaccaccgtggaggccagctgccccatcgtgaccgactgcgtgagcttccacgacagaatcctgatcacccccgacgagcacaagtacgccctgaaggtggtgtgccaggagaagcccaagctgagcctgaagttcaagatctgcaacaccaacatcgacgccagcatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgtgcatcatctgcctgctgatcgtgatctacatcatcctgcccatctgcttcaagctgagagacaccctgagacagcacgaggacgcctacaagaaggagatgaagatcagatga

SEQ ID NO: 9311 - RNA, 4332 nt, synthetic construct
  misc_feature 1..4332: note = derived and/or modified CDS sequence (opt4) from INKV(Lovanger)__KU681435.1__GP
  source 1..4332: mol_type = other RNA
atggaggtgctgaacctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacatcaagaacgccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggccatcttcatcttcctgaccatcgtgagcaagacctacgtgtgctacctgctgatgcccatcttcatccccatcgcctacatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcagaggccccgccagcgtgctgagcatcatgaccgccatcctgatcctgaccttcgtgacccccatcagcgccatggtgatcggcgagagcagcgaggtgtacaccctggacgagctgcccgacgacatggtgcagatggccgagagagtgaacatctactaccagatcatcatcatcaactacagcatcacctgggccttcctgctgttcggcctggtgctggcctacttcttcaagaagtaccagcacagattcctgagcttctacgccatgtactgcaaggagtgcgacatgtaccacgagagagccggcctgacctactggggcgacttcaccaacaagtgcagacagtgcacctgcggccagttcgaggacgtgaccggcctgatggtgcacaagaagagctacaactgcatcatcaagtacaaggccaagtggatcagagacatcctgatcacctacctgatcatcatgctgatcaaggacagcctgctgttcgtgggcgccaccggcaccgacttcgccgcctgcatcgacgagaagaccgtgacctggaactgcaccggccccttcctgaacctgggcagatgcgacaagagccagaagaagatcggctacgccgacatcgccgaccagctgaagggcctgggcgccatcagcgtgctggacatccccatgatcaagagaatgcccgacgagatcagcggcagcctgaagtacatcgacggcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagcacggcgacaagtgcaacagcgccaagtgggacttcgccaacgagatgaagaccttctacaccggccagaaggccaagttcaacaaggacctgaacctggccctgctggtgctgcacaaggccttcagaggcaccggcaccagctacatcgccgagagcatggccagaaaggacaacagaagcatgacccacttcgccctggagatcaagaagaagttccccaccaacgccctgctgaccgccctgatcgactacatcagctacctgcagagcctggccgagatgagcaccttcgagctggacgaggactgggaggacttcaagtacaagcccgagcccaccgaggccccccagctgagaagccacagaaccgaccagtacaacttcaagaacgccgacagcaacagcaacgtgaaggtgtgcaagaacatccagaaggtgagctgcatcagccccagaagcagagccaagttcgagaacatcatcgcctgcggcgagcacgccaaccccagcgtgtacatgatgcccaacgtgagcatctaccagagcaacagcgagagaagccactactgcatcgccgacagccactgcctggaggagtacgaggtggtggagagcgagctgctgaacgccctgaagaagagcaagtgctgggccaaggagatggacgacatcgtgctgcacaagcaggccgacggcctgagaagctgcagaatgaaggacaccggcaactgcaacgtgcaggagaacgactggaccatcgtgctgtgcgagaacggcaactactactacagcgaggcccacagagactacgacaaggaccaggacgtgggccacttctgcctgagccccagatgcagcaccatcagataccccatcaacaagagacacatcagaaactgcgactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcgtggagaccgtggagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcgtgaacaccaagcacgacgagaagtgcaccggcccctgcccccccatcatcgaccacaaggagggctggctgaccttcgccaaggagagaaccagcacctggggctgcgaggagttcggctgcctggccgtgagcgacggctgcgtgttcggcagctgccaggacatcatcaaggacgagctggtggtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagaatcatcgccatcaagaaccacgagatcaaggtgggccagatcaacgacctgggcgtgtacagcaagggctgcggcaacgtgcagaagatcaacggcaccaactacggcaacggctggcccaagttcgactacctgtgccacctggccagcagaaaggaggtgatcatcagaaagtgcttcgacaacgactacaaggcctgcaagttcctgcagagcccccccagctacagactggaggagcaccagggcaccgtgaccgtgatcgactacaagaagatcctgggcaccatcaagatgaaggccatcctgggcgacgtgaagtacaagaactaccagagcaacatcgagatcaacgccgagggcacctgcgccggctgcatcaactgcttcgagaacatccactgcgagttcaccatccacaccaccgtggaggccagctgccccatcgtgaccgactgcgtgagcttccacgacagaatcctgatcacccccgacgagcacaagtacgccctgaaggtggtgtgccaggagaagcccaagctgagcctgaagttcaagatctgcaacaccaacatcgacgccagcatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgtgcatcatctgcctgctgatcatcatctacatcatcctgcccatctgcttcaagctgagagacaccctgagacagcacgaggacgcctacaagaaggagatgaagatcagatga

SEQ ID NO: 9312 - RNA, 4332 nt, synthetic construct
  misc_feature 1..4332: note = derived and/or modified CDS sequence (opt4) from INKV(Lovanger)__KX554936.1__GP
  source 1..4332: mol_type = other RNA
atggaggtgctgaacctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacatcaagaacgccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggccatcttcatcttcctgaccatcgtgagcaagacctacgtgtgctacctgctgatgcccatcttcatccccatcgcctacatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcagaggccccgccagcgtgctgagcatcatgaccgccatcctgatcctgaccttcgtgacccccatcagcgccatggtgatcggcgagagcagcgaggtgtacaccctggacgagctgcccgacgacatggtgcagatggccgagagagtgaacatctactaccagatcatcatcatcaactacggcatcacctgggccttcctgctgttcggcctggtgctggcctacttcttcaagaagtaccagcacagattcctgagcttctacgccatgtactgcaaggagtgcgacatgtaccacgagagagccggcctgacctactggggcgacttcaccaacaagtgcagacagtgcacctgcggccagttcgaggacgtgaccggcctgatggtgcacaagaagagctacaactgcatcatcaagtacaaggccaagtggatcagagacatcctgatcacctacctgatcatcatgctgatcaaggacagcctgctgttcgtgggcgccaccggcaccgacttcgccgcctgcatcgacgagaagaccgtgacctggaactgcaccggccccttcctgaacctgggcagatgcgacaagagccagaagaagatcggctacgccgacatcgccgaccagctgaagggcctgggcgccatcagcgtgctggacatccccatgatcaagagaatccccgacgagatcagcggcagcctgaagtacatcgacggcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagcacggcgacaagtgcaacagcgccaagtgggacttcgccaacgagatgaagaccttctacaccggccagaaggccaagttcaacaaggacctgaacctggccctgctggtgctgcacaaggccttcagaggcaccggcaccagctacatcgccgagagcatggccagaaaggacaacagaagcatgacccacttcgccctggagatcaagaagaagttccccaccaacgccctgctgaccgccctgatcgactacatcagctacctgcagagcctggccgagatgagcaccttcgagctggacgaggactgggaggacttcaagtacaagcccgagcccaccgaggccccccagctgagaagccacagaaccgaccagtacaacctgaagaacgccgacagcaacagcaacgtgaaggtgtgcaagaacatccagaaggtgagctgcatcagccccagaagcagagccaagttcgagaacatcatcgcctgcggcgagcacgccaaccccagcgtgtacatgatgcccaacgtgagcatctaccagagcaacagcgagagaagccactactgcatcgccgacagccactgcctggaggagtacgaggtggtggagagcgagctgctgaacgccctgaagaagagcaagtgctgggccaaggagatggacgacatcgtgctgcacaagcaggccgacggcctgagaagctgcagaatgaaggacaccggcaactgcaacgtgcaggagaacgactggaccatcgtgctgtgcgagaacggcaactactactacagcgaggcccacagagactacgacaaggaccaggacgtgggccacttctgcctgagccccagatgcagcaccatcagataccccatcaacaagagacacatcagaaactgcgactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcgtggagaccgtggagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcgtgaacaccaagcacgacgagaagtgcaccggcccctgcccccccatcatcgaccacaaggagggctggctgaccttcgccaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagaatcatcgccatcaagaaccacgagatcaaggtgggccagatcaacgacctgggcgtgtacagcaagggctgcggcaacgtgcagaagatcaacggcaccaactacggcaacggcctgcccaagttcgactacctgtgccacctggccagcagaaaggaggtgatcatcagaaagtgcttcgacaacgactaccaggcctgcaagttcctgcagagcccccccagctacagactggaggagcaccagggcaccgtgaccgtgatcgactacaagaagatcctgggcaccatcaagatgaaggccatcctgggcgacgtgaagtacaagaactaccagagcaacatcgagatcaacgccgagggcacctgcgccggctgcatcaactgcttcgagaacatccactgcgagttcaccatccacaccaccgtggaggccagctgccccatcgtgaccgactgcgtgagcttccacgacagaatcctgatcacccccgacgagcacaagtacgccctgaaggtggtgtgccaggagaagcccaagctgagcctgaagttcaagatctgcaacaccaacatcgacgccagcatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgtgcatcatctgcctgctgatcgtgatctacatcatcctgcccatctgcttcaagctgagagacaccctgagacagcacgaggacgcctacaagaaggagatgaagatcagatga

SEQ ID NO: 9313 - RNA, 4335 nt, synthetic construct
  misc_feature 1..4335: note = derived and/or modified CDS sequence (opt4) from JSV__AF123487.1__GP
  source 1..4335: mol_type = other RNA
atggaggtgctgaacctgatctggctgctggccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgagcatcgtgagcaagacctacgtgtgctacctgctgatgcccatcttcatccccatcgccttcatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatgaccgccatcctgatcctgaccttcgtgacccccatcagcgccatggtgatcggcgagagcagcgaggtgtacaccctggacgacctgcccgacgacatggtgcagatggccgagagagtgaacatctactaccagatcatcatcatcaactacggcgtgacctgggccttcctgctgctgggcctgatcctggcctacttcttcaagaagtaccagcacaagttcctggacttctacgccatgtactgcgaggagtgcgacatgtaccacgagaagagcggcctgacccactggggcgacttcaccaacaagtgcagacagtgcacctgcggccagttcgaggacgtggccggcctgatgatccacagaaagagctacaactgcctggtgaagtacaaggccagatggatcagagacatcctgatcatgtacctggccatgatcctgatcaaggacagcctgctgttcgtgggcgccagcggcaccgacttcgccgcctgcatcgacgagaaggtggtgacctggaactgcaccggccccttcctgaacctgggcagatgcgacaagagccagaagaagaccaactacgagggcatcgccaaccagctgaagggcctgggcgtgatcagcgtgctggacatccccatgatcaagaacatgcccgacgagatcagcggcagcctgaagtacatcgacagcctggagacctaccacgagcagctgaccgccgagtacgccttcctgaccagatactgcgactactacacccagtacaccgacaacagcggctacagcagaaccgtgtggagaacctacctgagaagccacgacttcggcgcctgcgtggtgtaccccaaccaccacctgtgcagatgcgtgaagtacggcgacaagtgcaacagcgccaagtgggacttcgccaacgagatgaagaccttctacaccggccagaaggtgaagttcaacaaggacctgaacctggccctgctggtgctgcacaaggccttcagaggcaccggcaccgcctacgtggccgaggccatggccagaaaggacaacggcagcatggcccacttcgccctggagatcagaaagaagttccccaccaacgccctgctggccgccctgatcgactacatcgtgtacctgcagagcctggccgagatcgccaccttcgagctggacgaggactgggaggacttcaagtacaagcccgagcccaccgagagcaccccccaggccagaagccacagaaacgaccagtacaacttcaagaacgccgagagcaacagcaacaccaaggtgtgcaagaacgtgcagaaggtgctgtgcatcagccccagaagcaaggccaagttcgagaacatcatcgcctgcggcgagcacgccaaccccagcgtgtacatgatgcccaacgtgagcatctaccagagcaacagcgagagaagccactactgcatcgccgacagccactgcctggagaagtacgaggtggtggagaccgagctgctgaacgccctgaagaagagcaagtgctgggccaaggagatggacgacatcgtgctgcacaagcagagcgacggcctgagaagctgcagaatcaaggacaccggcaactgcaacgtgcaggagaacgactggaccatcgtgctgtgcgagaacggcaactactactacagcgaggtgcacaaggactacgacaaggaccaggacgtgggccacttctgcctgagccccagatgcaccaccatcagataccccatcagcagaagacacatcagaaagtgcgagtggcagatcagccacagcaccatcgacaagatcagcgtgcaggagctggccgacatcgagcagtacaagaaggccatcagccagaagctgcagaccagcctgagcatcttcaagtacgtgagaaccaagaacctgccccacatcaagcccgcctacaagtacatcaccgtggagggcgtggagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccgtgtacaccaagctgtacaccaccggccccaccatcggcatcaacaccaagcacgacgagaagtgcaccggcccctgccccgccgtgatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagagtgatcgccatcaagaaccacgagatcaaggtgggccagatcaacgacctgggcgtgtacagcaagggctgcggcaacgtgcagaaggtgaacggcaccaactacggcaacggcagccccagattcgactacctgtgccacctggccagcagaaaggaggtgatcctgagaaagtgcttcgacaacgactaccaggcctgcaagttcctgcagagccccagcagctacagactggaggagcaccagggcaccgtgaccgtgatcgactacaagaagatcctgggcaccatcaagatgaaggccatcctgggcgacgtgatctacatcaactaccagaacaacatcgagatcaacgccgagggcacctgcgccggctgcatcgactgcttcgagaacatccactgcgagttcaccatccacaccaccgtggaggccagctgccccatcaccaccgagtgcgtgagcttccacgacagaatcctgatcacccccgacgagcacaagtacgccctgaagatcgtgtgccacgacaagcccaaggtgagcctgaagttcaagatctgcaacaccaacgtggacgccgccatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgagcatcatctgcctgctgatcgtggtgtacatcatcctgcccatctgcttcaagctgagagacaccctgagacagcacgaggacgcctacagaaaggagatgaagatcagatga

SEQ ID NO: 9314 - RNA, 4335 nt, synthetic construct
  misc_feature 1..4335: note = derived and/or modified CDS sequence (opt4) from JSV(BFS 4474)__KX817319.1__GP
  source 1..4335: mol_type = other RNA
atggaggtgctgaacctgatctggctgctggccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgagcatcgtgagcaagacctacgtgtgctacctgctgatgcccatcttcatccccatcgccttcatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatgaccgccatcctgatcctgaccttcgtgacccccatcagcgccatggtgatcggcgagagcagcgaggtgtacaccctggacgacctgcccgacgacatggtgcagatggccgagagagtgaacatctactaccagatcatcatcatcaactacggcgtgacctgggccttcctgctgctgggcctgatcctggcctacttcttcaagaagtaccagcacaagttcctggacttctacgccatgtactgcgaggagtgcgacatgtaccacgagaagagcggcctgacccactggggcgacttcaccaacaagtgcagacagtgcacctgcggccagttcgaggacgtggccggcctgatgatccacagaaagagctacaactgcctggtgaagtacaaggccagatggatcagagacatcctgatcatgtacctggccatgatcctgatcaaggacagcctgctgttcgtgggcgccagcggcaccgacttcgccgcctgcatcgacgagaaggtggtgacctggaactgcaccggccccttcctgaacctgggcagatgcgacaagagccagaagaagaccaactacgagggcatcgccaaccagctgaagggcctgggcgtgatcagcgtgctggacatccccatgatcaagaacatgcccgacgagatcagcggcagcctgaagtacatcgacagcctggagacctaccacgagcagctgaccgccgagtacgccttcctgaccagatactgcgactactacacccagtacaccgacaacagcggctacagcaagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggccagaaggtgaagttcaacaaggacctgaacctggccctgctggtgctgcacaaggccttcagaggcaccggcaccgcctacgtggccgaggccatggccagaaaggacaacggcagcatggcccacttcgccctggagatcagaaagaagttccccaccaacgccctgctggccgccctgatcgactacatcgtgtacctgcagagcctggccgagatcgccaccttcgagctggacgaggactgggaggacttcaagtacaagcccgagcccaccgagagcaccccccaggccagaagccacagaaacgaccagtacaacttcaagaacgccgagagcaacagcaacaccaaggtgtgcaagaacgtgcagaaggtgctgtgcatcagccccagaagcaaggccaagttcgagaacatcatcgcctgcggcgagcacgccaaccccagcgtgtacatgatgcccaacgtgagcatctaccagagcaacagcgagagaagccactactgcatcgccgacagccactgcctggagaagtacgaggtggtggagaccgagctgctgaacgccctgaagaagagcaagtgctgggccaaggagatggacgacatcgtgctgcacaagcagagcgacggcctgagaagctgcagaatcaaggacaccggcaactgcaacgtgcaggagaacgactggaccatcgtgctgtgcgagaacggcaactactactacagcgaggtgcacaaggactacgacaaggaccaggacgtgggccacttctgcctgagccccagatgcaccaccatcagataccccatcagcagaagacacatcagaaagtgcgagtggcagatcagccacagcaccatcgacaagatcagcgtgcaggagctggccgacatcgagcagtacaagaaggccatcagccagaagctgcagaccagcctgagcatcttcaagtacgtgagaaccaagaacctgccccacatcaagcccgcctacaagtacatcaccgtggagggcgtggagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccgtgtacaccaagctgtacaccaccggccccaccatcggcatcaacaccaagcacgacgagaagtgcaccggcccctgccccgccgtgatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagagtgatcgccatcaagaaccacgagatcaaggtgggccagatcaacgacctgggcgtgtacagcaagggctgcggcaacgtgcagaaggtgaacggcaccaactacggcaacggcagccccagattcgactacctgtgccacctggccagcagaaaggaggtgatcctgagaaagtgcttcgacaacgactaccaggcctgcaagttcctgcagagccccagcagctacagactggaggagcaccagggcaccgtgaccgtgatcgactacaagaagatcctgggcaccatcaagatgaaggccatcctgggcgacgtgaagtacaagaactaccagaacaacatcgagatcaacgccgagggcacctgcgccggctgcatcgactgcttcgagaacatccactgcgagttcaccatccacaccaccgtggaggccagctgccccatcaccaccgagtgcgtgagcttccacgacagaatcctgatcacccccgacgagcacaagtacgccctgaagatcgtgtgccacgacaagcccaaggtgagcctgaagttcaagatctgcaacaccaacgtggacgccgccatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgagcatcatctgcctgctgatcgtggtgtacatcatcctgcccatctgcttcaagctgagagacaccctgagacagcacgaggacgcctacagaaaggagatgaagatcagatga

SEQ ID NO: 9315 - RNA, 4323 nt, synthetic construct
  misc_feature 1..4323: note = derived and/or modified CDS sequence (opt4) from LUMV__AF123484.1__GP
  source 1..4323: mol_type = other RNA
atgatcctggtgctgttcttcgtggccctgagcgccgccggccccgtgtaccagagatgcttccaggacggcgccatcgtgaagcagagccccagcaagcaggccgtgaccgaggtgtgcctgaaggacgacgtgagcatgatcaagaccgaggccagatacttcaagaacaccaccggcatctacgccaacaacgtggccatcagaaagtggctggtggccgactggcacgactgcagacccaagaaggtgagcggcggccacatcaacgtgatcgaggtgggcgacgacctgaccctgcacaccgaggcctacgtgtgcaacgccgactgcatcatcggcgtggacaaggagaccgcccaggtgagactgcagaccgacaccaccaaccacttcgagatcgccggcaccaccgtgaagagcggctggttcaagagcaccacctacatcaccctgggccagacctgcgagcacctgaaggtgagctgcggccccaagagcatccagttccacgcctgcttcaaccagcacatgagctgcgtgagattcctgcacagaaccatcctgcccggcagcatcgccaacagcgtgtgccagaacatcgagatcatcatcctgaccgtgctgaccctgctgatcttcaccctgctgagcatcctgagcaagacctacatctgctacatcctgatgcccatcttcatccccctggcctacatctacggcctgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcgtgctgagcatcatcaccgccgtgctgatcctgaccttcatcacccccatcaacgccatgatcgccggcgagacccaggagaccttcaagctggaggacctgcccgacgacatgctgagcatggccatgaagatcaacatgtactacatcatgtgcatgctgaactacgtggccacctggagcttcatcttctgcgccctgatcatcgccctgatcttcaagaagtaccagcacaagttcctgagctactacgccatgtactgccaggagtgcgacatgtaccacgacagaagcggcctgaagtacaacggcggcttcaccaacaagtgcagacagtgcacctgcggccagtacgaggacgccaccggcctgatggcccacagaaagacctacaactgcctgatccagtacaagagcaagtggctggtgaacttcctgatcacctacatcatcctgatgctgatcaaggacagcgtgctgatcgtgcacgccgagggcaccgacttcgagaagtgcagcagcgacatcaacatcgtgtggaactgcaccggccccttcctgagcctgggcaactgcgagaagaagcagaagaaggagagctacaacgacatcgccgcccagctgaagggcctggacgccatcagcgtgctggacatccccatgatcagcaagatccccgaggacatcgccggcgccctgagattcatcgaggagcagaacagctaccacgtgcagctgaccgtggagtacgccatgctgaccagatactgcgactactacacccagttcagcgacaacagcggctacagccagaccacctggagaacctacctgagaagccacgacttcgaggcctgcatcctgtaccccaaccagcacttctgcagatgcgtgaagcacggcgacaagtgcagcagaagcaactgggacttcgccaacgagatgaagaactactacagcggcaagcagagcaagtacaacaaggacctgaacctggccctgatgagcttccaccacgccttcagaggcaccagcagcttctacaccgccaagctgctgagagagaagaagaccgaggagctgaagaactacatcgacaagatcagaaccgagtaccccggcaacgccctgctgaaggccgtgatcgactacatcaagtacatgatgggcctgaccgaggtgagcaacttcaagcacgacgagatgtgggacgacttcatcttcgagaaccccagcaccagaagcagcctgagcagaaacagcgagagcagctacgacttcaagaccaacatcaacagcgaccccaccaacacctgcaagaacatcaaggccgtgacctgcctgagccccaagagcggcgtgagcttcgacagcgtgatcgcctgcggcgagagcaaccagcccagcatctaccagaagcccagaaagcaggtgtaccagagcaacagcgagcagacccacttctgcctgctggacacccactgcctggagggctacgagaccgtgggcgaggaggtgctgagcgccatcaagaagagcaagtgctgggagaccgacttcaccgagtacatccagttcaagcagagcgacggcgtgagaagctgcagaatgaaggacagcggcgagtgcaccgtgaccaccaacaagtggcccatcatcctgtgcgagaacaacagatactactacagcgagctgcacaaggactacgacaaggaccaggacatcggccacttctgcctgagccccagatgcaacaccatcagataccccatcaaccagaaccacatcagcaactgcacctggcaggtgagacacaacaacatcgacaagatcgaggtgcacgagctggaggacctggagcagtacagaaaggccatcacccagaagctgcagaccagcctgaccctgttcaagtacagcagaaccaagaacctgccccacatcaagcccatctacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcagctacgtgaagagcgccagctacagcgccgtgtacaccaagctgtacaccaccggccccaccatcggcgtgaacaccaagcacgacgagctgtgcaccggcagctgccccgtgaacgtgccccacaacaccggctggctgaccttcgccagagagagaaccagcagctggggctgcgaggagttcggctgcctggccatcagcgacggctgcgtgttcggcagctgccaggacatcatcaaggacgagctgaccgtgtacagagaggagaccgaggagaccaccaacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaagatcaacaacaccaactacggcaacggcgtgcccaagttcgactacctgtgccacctggccagcagaaaggaggtgatcatcagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacatcaccgtggagggcgcctgcaccggctgcatcaactgcttcgacaacatccactgcgagctgaccatccacagcaccgtggaggccagctgccccatcaccagcagctgcaccgtgttccacgacagaatcctgatcacccccaacgagcacaagtacgccatcaaggtgatctgcaacggcaagcccggcatcagcctgcccttcaagatctgcaacaccaaggtggacgccgccatgaccctgaccgacgccaagcagatcctggagctggcccccgtggaccagaccacctacatcaaggagaaggacgagagatgcaagacctggatgtgcagagtgagagacgagggcctgcaggtgatcttcgagcccttcaagaacctgttcggcagctacatcggcatcttctacaccttcgtgatcttcctggtggtgatcttcatcgtgatctacatcgtgctgcccatctgcttcaagctgagagacaccctgagacagcacgaggacgcctacaagagagagatgaagatcagatga

SEQ ID NO: 9316 - RNA, 4323 nt, synthetic construct
  misc_feature 1..4323: note = derived and/or modified CDS sequence (opt4) from LUMV(SAAr 1881)__KX817325.1__GP
  source 1..4323: mol_type = other RNA
atgatcctggtgctgttcttcgtggccctgagcgccgccggccccgtgtaccagagatgcttccaggacggcgccatcgtgaagcagagccccagcaagcaggccgtgaccgaggtgtgcctgaaggacgacgtgagcatgatcaagaccgaggccagatacttcaagaacaccaccggcatctacgccaacaacgtggccatcagaaagtggctggtggccgactggcacgactgcagacccaagaaggtgagcggcggccacatcaacgtgatcgaggtgggcgacgacctgaccctgcacaccgaggcctacgtgtgcaacgccgactgcatcatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcgtgtgccagaacatcgagatcatcatcctgaccgtgctgaccctgctgatcttcaccctgctgagcatcctgagcaagacctacatctgctacatcctgatgcccatcttcatccccctggcctacatctacggcctgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcgtgctgagcatcatcaccgccgtgctgatcctgaccttcatcacccccatcaacgccatgatcgccggcgagacccaggagaccttcaagctggaggacctgcccgacgacatgctgagcatggccatgaagatcaacatgtactacatcatgtgcatgctgaactacgtggccacctggagcttcatcttctgcgccctgatcatcgccctgatcttcaagaagtaccagcacaagttcctgagctactacgccatgtactgccaggagtgcgacatgtaccacgacagaagcggcctgaagtacaacggcggcttcaccaacaagtgcagacagtgcacctgcggccagtacgaggacgccaccggcctgatggcccacagaaagacctacaactgcctgatccagtacaagagcaagtggctggtgaacttcctgatcacctacatcatcctgatgctgatcaaggacagcgtgctgatcgtgcacgccgagggcaccgacttcgagaagtgcagcagcgacatcaacatcgtgtggaactgcaccggccccttcctgagcctgggcaactgcgagaagaagcagaagaaggagagctacaacgacatcgccgcccagctgaagggcctggacgccatcagcgtgctggacatccccatgatcagcaagatccccgaggacatcgccggcgccctgagattcatcgaggagcagaacagctaccacgtgcagctgaccgtggagtacgccatgctgaccagatactgcgactactacacccagttcagcgacaacagcggctacagccagaccacctggagaacctacctgagaagccacgacttcgaggcctgcatcctgtaccccaaccagcacttctgcagatgcgtgaagcacggcgacaagtgcagcagaagcaactgggacttcgccaacgagatgaagaactactacagcggcaagcagagcaagtacaacaaggacctgaacctggccctgatgagcttccaccacgccttcagaggcaccagcagcttctacaccgccaagctgctgagagagaagaagaccgaggagctgaagaactacatcgacaagatcagaaccaagtaccccggcaacgccctgctgaaggccgtgatcgactacatcaagtacatgatgggcctgaccgaggtgagcaacttcaagcacgacgagatgtgggacgacttcatcttcgagaaccccagcaccagaagcagcctgagcagaaacagcgagagcagctacgacttcaagaccaacatcaacagcgaccccaccaacacctgcaagaacatcaaggccgtgacctgcctgagccccaagagcggcgtgagcttcgacagcgtgatcgcctgcggcgagagcaaccagcccagcatctaccagaagcccagaaagcaggtgtaccagagcaacagcgagcagacccacttctgcctgctggacacccactgcctggagggctacgagaccgtgggcgaggaggtgctgagcgccatcaagaagagcaagtgctgggagaccgacttcaccgagtacatccagttcaagcagagcgacggcgtgagaagctgcagaatgaaggacagcggcgagtgcaccgtgaccaccaacaagtggcccatcatcctgtgcgagaacaacagatactactacagcgagctgcacaaggactacgacaaggaccaggacatcggccacttctgcctgagccccagatgcaacaccatcagataccccatcaaccagaaccacatcagcaactgcacctggcaggtgagacacaacaacatcgacaagatcgaggtgcacgagctggaggacctggagcagtacagaaaggccatcacccagaagctgcagaccagcctgaccctgttcaagtacagcagaaccaagaacctgccccacatcaagcccatctacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcagctacgtgaagagcgccagctacagcgccgtgtacaccaagctgtacaccaccggccccaccatcggcgtgaacaccaagcacgacgagctgtgcaccggcagctgccccgtgaacgtgccccacaacaccggctggctgaccttcgccagagagagaaccagcagctggggctgcgaggagttcggctgcctggccatcagcgacggctgcgtgttcggcagctgccaggacatcatcaaggacgagctgaccgtgtacagaaaggagaccgaggagaccaccaacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaagatcaacaacaccaactacggcaacggcgtgcccaagttcgactacctgtgccacctggccagcagaaaggaggtgatcatcagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacatcaccgtggagggcgcctgcaccggctgcatcaactgcttcgacaacatccactgcgagctgaccatccacagcaccgtggaggccagctgccccatcaccagcagctgcaccgtgttccacgacagaatcctgatcacccccaacgagcacaagtacgccatcaaggtgatctgcaacggcaagcccggcatcagcctgcccttcaagatctgcaacaccaaggtggacgccgccatgaccctgaccgacgccaagcagatcctggagctggcccccgtggaccagaccacctacatcaaggagaaggacgagagatgcaagacctggatgtgcagagtgagagacgagggcctgcaggtgatcttcgagcccttcaagaacctgttcggcagctacatcggcatcttctacaccttcgtgatcttcctggtggtgatcttcatcgtgatctacatcgtgctgcccatctgcttcaagctgagagacaccctgagacagcacgaggacgcctacaagagagagatgaagatcagatga

SEQ ID NO: 9317 - RNA, 4329 nt, synthetic construct
  misc_feature 1..4329: note = derived and/or modified CDS sequence (opt4) from MELV__U88057.1__GP
  source 1..4329: mol_type = other RNA
atgatcgccctgatcttcctgatcgccatcgccgccgccagccccgtgtaccagagatgcttccaggacggcggcatcgtgaagcagaaccccagcaaggacgccgtgaccgaggtgtgcctgaaggacgacgtgagcatgatcaagaccgaggccaagtacatgaagaacgacaccggcaccttcagcaacaacgtggccatgagaaagtggctggtggccgactggcacgactgcagaccccagaagagcagcggcggccacatcaacgtgatcgaggtgggcgacgacctgagcctgcacaccgaggcctacatctgcagcgccgactgcatgatcagcgtggacaaggagaccgcccagatcagactgcagaccgacagcaccacccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcttcctgagcatcctgagcaagacctacatctgctacatcctgatgcccatgttcatccccgtggcctacatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagaagcagcggcctgtgccccggctacaagagcctgagagccgccagagtgatgtgcaagagcaagggccccgccagcatcctgagcgtgctgaccgccgtgctgatcctgaccttcgtgacccccatgaacgccctgaccctgggcagcagcgaggagaactacaagctggagaacctgcccgacgacatgctggacatggccgagagaatcgacatctactacctgagcatcatcctgaactacagcatcacctggggcctggtgatcctgctgggcctgaccttcatcctgttcagaagattccagcacagattcctgaactgctacgccatgtactgcagcgagtgcgacatgtaccacgacaagaacggcctggtgagaaacggcgacttcaccaacaagtgcagacagtgcacctgcggccagtacgaggacgccgccggcctgatcatccaccagaagagctacaactgcctgatcaagtacaaggccaagtggatcagaaacatcctgctgacctacatcatcctgatcctgatcaaggacagcgtgctgctgaccagcgccgagggccccgacttcagcgtgtgcatcgagcagaaggccatcagctggaactgcaccggccccttcctgaacctgggcagatgcgagaagacccagaagaaggccagctacgccaccatcgccacccagctgagaagcatcgacgccatcagcgtgctggacatccccatgatcgccaagatccccgaggacatcagcggcgccctgaagtacatcgagagcctgaagacctaccacgagcagctgaccgccgagtacgccatgctgaccagatactgcgactactacacccagttcagcgacaacagcggctacagccagaccagctggagaaagttcctgagaagccacgacttcgagagctgcatcatctaccccaaccagcacttctgcagatgcgtgaagcaggacgagaagtgcagcagcgccaagtgggacttcgccagcgagatgaagggcttctacctgaacaagcaggccaagttcaacaaggacctgaacctggccctgagcaccttccacaaggccttcagaggcacccccatcagctacgtgaccgagctgatcagcaagaacaagaacagcagcctgctgatgtacgtgagcgagatcaagagaaagttccccggcaacgccctgctggtggccctgctggacttcatcatgtacctgcagagcctgagcgagatcagcggcttcgagctgggcgacgagtgggaggacttcaagtacgaccccgagcccaccgagcccgccctgatgcccagaagccacagaagcgaccagtacaacttcaagaacgccgccagcgtgagcaagaccaagacctgcgagaacatcaagagagtgctgtgcctgagccccagaagcagagccaccttcgacgacgtggtggcctgcggcgagttcgccaaccccagcgtgtacatgctgcccaacatcaccatctaccagagcaacatcgagagaagccactactgcatcgccgacagccactgcctggaggagttcgagctggtgaagcccgagctgctgaccgccctgaagaagagcacctgctgggccggcgagatcgacgacatcgtgctgcacaagcagagcgacggcctgagaagctgcagaatcaaggacaccggcacctgcgacgtgctgggcaacgagtggaccatcgtgctgtgcgagaacaacaacttctactacagcgaggtgcacagagactacgacaaggaccaggacatcggccacttctgcctgagccccagatgcaacatcatcagataccccatcaaccccagacacatcagaacctgcaagtggcagatcagccacagcaccatcgacaagatcaccgtgcacgagctggccgacatcgagcagtacaagaaggccatcacccagaagctgcagaacagcctgagcatcttcaagtacaagagaaccaagaacctgccccacatcaagcccatctacaagtacatcgccatcgagggcaccgagaccgtggagggcatcgagaacgcctacatcgagagcgagatccccgccctggccggcaccgccatcggcttcaagatcaacagcaaggacggcaaccacctgatggacgtgatcggctacgtgaagagcgccagctacagcagcacctacaccaagctgtacaccaccggccccaccatcggcatcaacaccaagcacgacgagaagtgcaccggcagctgccccacccaggtgaagcacaagaccggctggctgaccttcgccaaggagagaaccagcacctggggctgcgaggagttcggctgcctggccatcagcgacggctgcgtgttcggcagctgccaggacatcatcaaggacgagctgaccgtgtacagaaagaccaccgacgaggtgaccgagctggagctgtgcctgaccttcgccgacaagacctactgcaccaacctgaacgccgtgacccccatcatcaccgacaagttcgaggtgcagttcaagaccgtggagagctacagcctgcccagaatcatcgccgtgaagaaccacgagatcaaggtgggccagatcaacgacatcggcgtgtacagcaagggctgcggcaacgtgcagaaggtgaacggcaccagctacggcaacggcgtgcccaagttcgactacctgtgccacctggccagcagaaaggaggtgaccatcagaaagtgcttcgacaacgactaccaggcctgcaagttcctgcagacccccagcagctacagactggaggagcaccagggcaccgtgaccatcatcgactacaagaagatcctgggcagcatcaagatgaaggccatcctgggcgacgtgaagtacaagaactacgccagcaacatcgacatcaacgccgagggcagctgcgccggctgcatcaactgcttcgagaacatccactgcgagttcaccatccacagcaccgtggagaccagctgccagatcgagagcgactgcaccagcttccacgacagagtgctgatcacccccaacgagcacaagtacgccctgaagctgatctgccacgacaagcccgccagcagcctgaagttcaagatctgcaacaccaaggtggaggccgccatgaccctggtggacgccagacccatcatcgagctggcccccgtggaccagaccgcctacatcagagagaaggacgagagatgcaagacctggatgtgcagagtgagagacgagggcatccaggtgatcttcgagcccttcaagaacctgttcggcagctacatcggcatcttctacgccatcgtgatctgcatcatcgtgctgttcctgatcgtgtacatcgtgctgcccatctgcttcaagctgaaggacaccctgaagcagcacgaggacgcctacaagagagagatgaagatcagatga

SEQ ID NO: 9318 - RNA, 4326 nt, synthetic construct
  misc_feature 1..4326: note = derived and/or modified CDS sequence (opt4) from SAV__AF123486.1__GP
  source 1..4326: mol_type = other RNA
atgatccccctgctgttcctggtgaccctggtgagcgccggccccgtgttccagagatgcttccaggacggcgccatcgtgaagcagaaccccagcaaggaggccgtgaccgaggtgtgcatcaaggacgacgtgagcatgatcaagaccgaggccagatacgtgagaaacagcagcggcgtgttcagcaacaacgtggccctgagaaagtggctggtgagcgactggcacgactgcaagcccaagaaggtgagcggcggccacatcaacgtgatcgaggtgggcaacgacctgaccctgcacaccgagagctacgtgtgcagcgccgactgcaccatcggcatcgacaaggagaccgcccagatcagactgcagaccgacaccaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatggccaacagcatctgccagaacatcgagatcatcatcctgaccaccctggccctgctgatcttcctgctgctgaccatcctgagcaagacctacatctgctacctgctgatgcccatcttcatccccatcgcccacctgtacggcctgatctacaacaagagctgcaagaagtgccagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcaacctgagcatcatcaccgccgtgctgaccctgaccttcgtgacccccatcaacggcctgaccatcggcgacagcaaggaggtgctgaaccccgacgagctgcccgacgacatgctggagatggcccagaagctgaacatgtaccagctgatctgcatcatcaactacaccgccacctggagcatcatcatcatcggcctggccgtgttctacatcttcaagaagtaccagcacagattctacaactactacgccatgtactgccaggagtgcgacatgtaccacgagagaagcggcctgaagtggaacggcgacttcaccaacaagtgcagacagtgcacctgcggcgagtacgaggacgccgccggcctgatcagccacagaaagagctacaactgcctgctgcagtacaaggtgaagtgggtgatgaacttcctgaccatctacgtggccctgatcatcctgaaggacagcaccctgatcgtgcaggccgccggcaccgacttcagcgactgcatcgagaccgaggagctgaactggaactgcaccggccccttcctgaacctgggcaactgcgagaagaagcagaagaaggagagctacagcaacatcgccgagcagctgaagggcctgcaggccatcagcgtgctggacatccccctgatcgccagaatccccgaggacatcagcggcggcctgagatacatcgagagcatcagaacccaccacgcccagctgaccgccgagtacgccatgctgaccagatactgcgactaccacaagctgttcggcgacaacagcggctacagccagaccacctggagaatgtacctgagaagccacgacttcggcgcctgcatcctgtaccccaaccagcacttctgcagatgcgtgaagcacggcgagaagtgcagcagcagcagctgggacttcgccagcgagatgaagaactactacagcggcaagcagggcaagttcaacaaggacctgaacctggccctgcagagcatccaccacgccttcagaggcaccagcagcagctacatcgccaccatcctgagcgagaagagaaacgaccagctggtggagtacatggagaagctgagagagaagttcatcggcaacgccctgctgagagccgtgctggacttcatcacctacatgaagagcctgaccgagatgaccaacttcaagcacgacgagttctgggacgagttcgtgcacctgcccgcccccaccaaggcccccagcatgagaagaagcggcaacgagaactacgacttcaaggcccccaccagccccgccggcaccaagagctgcaagaacatcaagaacgtggtgtgcctgagccccagaagcggcgccagctacgagggcatcgtggcctgcggcgagcccagcgccccccagatcttcaagatgcccagcgagagcatctaccacaacaacgccgaccagagcatgtactgcatcgccgacacccactgcctgcaggactacagccccgtggaggacgaggagctgaacgccatcaagaagagcaagtgctgggagaccgagttcaccaacgccgtgcccttcaagcagagcgacggcatcagaagctgcagaatgagagacagcggcaactgcaacgtgaccaccaacctgtggcccgtgatgcagtgcgacgacggcaagttctactacagcgagcaccagaaggactacgacaaggaccaggacatcggccacttctgcctgagccccagatgcaacatggtgagattccccatcagcgagaagaacatcctggcctgcgactggatcgtgagccaccccaacatcgacaagatcgacgtgcacagcctggaggacctggagcagtacaagaaggccatcacccagaagctgcagaccagcctgagcatcttcaagtacgccaagaccatgaacctgccccacgtgaagcccatctacaagtacatcagcatcgagggcaccgagaccgccgagggcgtggagaacgccttcatcgagagcgagatccccgccctggccggcaccagcatcggcttcaaggtgaacagcaaggacggcaagcacatcatggacatcatcggctacgtgaagaccgccagctacagcagcgtgtacaccaagctgtacaccaccagccccaccaccggcgtgaacaccaagcacgacgagctgtgcaccggcccctgccccaagcagatcgagcacaagaacggctggatcaccttcagcaaggagagaaccagcagctggggctgcgaggagttcggctgcctggccatcagcgacggctgcgtgttcggcagctgccaggacatcatcaaggacgagatgagcgtgtacagaaaggagaccgaggagaccaccatcgtggagctgtgcctgaccttcagcgacaagacctactgcgtggagctgaaccccgtgacccccatcatcaccgacctgttcgaggtgcagttcaagaccgtggagagctacaccctgcccagaatcgtggccgtgaagaaccacgaggtgatggtgggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcatcagaaagtgcttcgacaacgactaccaggcctgcaagttcctgcagagccccagcagctacagactggaggaggacgccagcaccgtgagcatcatcgactacaagaagatcctgggcaccatcaagatgaaggccatcctgggcgacgtgagatacaagaccttcagcgagagcatcgacatcagcgccgagggcacctgcaccggctgcgtgaactgcttcgagaacatccactgcgagttcaccatccacagcaccgtggaggccagctgccccgtggtgagcacctgcaccctgttccacgacagaatcctgatcggccccgacaaccacaagtacgccatgaaggtgatctgcaccgaggcccccaagaccagcctgagcttcaagatctgcaacaccaaggtggacgccgccatcaccatcgtggacagcaagcccatcgtggagctggcccccgtggaccagaccgcctacatcagagagaaggacgacagatgcaagacctggatgtgcagagtgagagacgagggcatgcaggtgctgagcgagcccttcaagaacctgttcggcagctacatcggcatcttctacaccggcctggccgtgctgatcatcgccctgatcgccgtgtacatcgtgatgcccatctgcttcaaggtgaaggacatcctgaagaagcacgacgacgcctacagaagagagctgaagatcagatga

SEQ ID NO: 9319 - RNA, 4326 nt, synthetic construct
  misc_feature 1..4326: note = derived and/or modified CDS sequence (opt4) from SAV(20230)__KX817331.1__GP
  source 1..4326: mol_type = other RNA
atgatccccctgctgttcctggtgaccctggtgagcgccggccccgtgttccagagatgcttccaggacggcgccatcgtgaagcagaaccccagcaaggaggccgtgaccgaggtgtgcatcaaggacgacgtgagcatgatcaagaccgaggccagatacgtgagaaacagcagcggcgtgttcagcaacaacgtggccctgagaaagtggctggtgagcgactggcacgactgcaagcccaagaaggtgagcggcggccacatcaacgtgatcgaggtgggcaacgacctgaccctgcacaccgagagctacgtgtgcagcgccgactgcaccatcggcatcgacaaggagaccgcccagatcagactgcagaccgacaccaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatggccaacagcatctgccagaacatcgagatcatcatcctgaccaccctggccctgctgatcttcctgctgctgaccatcctgagcaagacctacatctgctacctgctgatgcccatcttcatccccatcgcctacctgtacggcctgatctacaacaagagctgcaagaagtgccagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacggcctgaccatcggcgacagcaaggaggtgttcaacctggacgagctgcccgacgacatgctggagatggcccagaagctgaacatgtaccagctgatctgcatcatcaactacaccgccacctggagcatcatcatcatcggcctggccgtgttctacatcttcaagaagtaccagcacagattctacaactactacgccatgtactgccaggagtgcgacatgtaccacgagagaagcggcctgaagtggaacggcgacttcaccaacaagtgcagacagtgcacctgcggcgagtacgaggacgccgccggcctgatcagccacaagaagagctacaactgcctgctgcagtacaaggtgaagtgggtgatgaacttcctgaccatctacgtggccctgatcatcctgaaggacagcaccctgatcgtgcaggccgccggcaccgacttcagcgactgcatcgagaccgaggagctgaactggaactgcaccggccccttcctgaacctgggcaactgcgagaagaagcagaagaaggagagctacagcaacatcgccgagcagctgaagggcctgcaggccatcagcgtgctggacatccccctgatcgccagaatccccgaggacatcagcggcggcctgagatacatcgagagcatcagaacccaccacgcccagctgaccgccgagtacgccatgctgaccagatactgcgactactacaagctgttcggcgacaacagcggctacagccagaccacctggagaatgtacctgagaagccacgacttcgaggcctgcatcctgtaccccaacagacacttctgcagatgcgtgaagcacggcgagaagtgcagcagcagcagctgggacttcgccagcgagatgaagaactactacagcggcaagcagggcaagttcaacaaggacctgaacctggccctgcagagcatccaccacgccttcagaggcaccagcagcagctacatcgccaccatcctgagcgagaagagaaacgaccagctggtggagtacatgaagaagctgagagagaagttcatcggcaacgccctgctgagagccgtgctggacttcatcacctacatgaagagcctgaccgagatgaccaacttcaagcacgacgagttctgggacgagttcgtgcacctgcccgcccccaccaaggcccccagcatgagaagaagcggcaacgagaactacgacttcaaggcccccaccagccccgccggcaccaagagctgcaagaacatcaagaacgtggtgtgcctgagccccagaagcggcgccagctacgagggcatcgtggcctgcggcgagcccagcgccccccagatcttcaagatgcccagcgagagcatctaccacaacaacgccgaccagagcatgtactgcatcgccgacacccactgcctgcaggactacagccccgtggaggacgaggagctgaacgccatcaagaagagcaagtgctgggagaccgagttcaccaacgccgtgcccttcaagcagagcgacggcatcagaagctgcagaatgagagacagcggcaactgcaacgtgaccaccaacctgtggcccgtgatgcagtgcgacgacggcaagttctactacagcgagcaccagaaggactacgacaaggaccaggacatcggccacttctgcctgagccccagatgcaacatggtgagattccccatcagcgagaagaacatcctggcctgcgactggatcgtgagccaccccaacatcgacaagatcgacgtgcacagcctggaggacctggagcagtacaagaaggccatcacccagaagctgcagaccagcctgagcatcttcaagtacgccaagaccatgaacctgccccacatcaagcccatctacaagtacatcagcatcgagggcaccgagaccgccgagggcgtggagaacgccttcatcgagagcgagatccccgccctggccggcaccagcatcggcttcaaggtgaacagcaaggacggcaagcacatcatggacatcatcggctacgtgaagaccgccagctacagcagcgtgtacaccaagctgtacaccaccggccccaccaccggcgtgaacaccaagcacgacgagctgtgcaccggcccctgccccaagcagatcgagcacaagaacggctggatcaccttcagcaaggagagaaccagcagctggggctgcgaggagttcggctgcctggccatcagcgacggctgcgtgttcggcagctgccaggacatcatcaaggacgagatgagcgtgtacagaaaggagaccgaggagaccaccatcgtggagctgtgcctgaccttcagcgacaagacctactgcgtggagctgaaccccgtgacccccatcatcaccgacctgttcgaggtgcagttcaagaccgtggagagctacaccctgcccagaatcgtggccgtgaagaaccacgaggtgatggtgggccagatcaacgacctgggcgtgtacagcaagggctgcggcaacgtgcagaaggtgaacggcaccgtgtacggcaacggcgtgcccaagttcgactacctgtgccacctggccagcagaaaggaggtgatcatcagaaagtgcttcgacaacgactaccaggcctgcaagttcctgcagagccccagcagctacagactggaggaggacgccagcaccgtgagcatcatcgactacaagaagatcctgggcaccatcaagatgaaggccatcctgggcgacgtgagatacaagaccttcagcgagagcatcgacatcagcgccgagggcacctgcaccggctgcgtgaactgcttcgagaacatccactgcgagttcaccatccacagcaccgtggaggccagctgccccgtggtgagcacctgcaccctgttccacgacagaatcctgatcggccccgacaaccacaagtacgccatgaaggtgatctgcaccgaggcccccaagaccagcctgagcttcaagatctgcaacaccaaggtggacgccgccatcaccatcgtggacagcaagcccatcgtggagctggcccccgtggaccagaccgcctacatcagagagaaggacgacagatgcaagacctggatgtgcagagtgagagacgagggcatgcaggtgctgctggagcccttcaagaacctgttcggcagctacatcggcatcttctacaccggcctggccgtgctgatcatcgccctgatcgccgtgtacatcgtgatgcccatctgcttcaaggtgaaggacatcctgaagaagcacgacgacgcctacagaagagagctgaagatcagatga

SEQ ID NO: 9320 - RNA, 4329 nt, synthetic construct
  misc_feature 1..4329: note = derived and/or modified CDS sequence (opt4) from SDNV__AF123490.1__GP
  source 1..4329: mol_type = other RNA
atgatctgcatcctgctgctgatcgccctggccagcgccagccccgtgtaccagagatgcttccaggacggcgccatcgtgaagcagtaccccgccaaggacgccgtgaccgaggtgtgcctgaaggacgacgtgagcatgatcaagacccaggccaactacatgaagaacaccaccggcaccttcagcaacaacgtggccatgagaaagtggctggtggccgactggcacgactgcagaccccagaagagcagcggcggccacatcaacgtgatcgaggtgggcgacgacctgagcctgcacaccgaggcctacatctgcagcgccgactgcgtgatcagcatcgacaaggagaccgcccagatcagactgcagaccgacagcaccaaccacttcgaggtgagcggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatggccaacagcatctgccagaacatcgagatcatcatcctggtgaccctgaccctgatgatcttcatcctgctgaccatcatcagcaagacctacatctgctacatcctgatgcccatcttcatccccatcgcctacatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagaagcagcggcctgtgccccggctacaagagcctgagagccgccagagtgatgtgcaagagcagaggccccgccagcatcctgagcatcctgaccgccgtgctgatcctgaccttcgtgacccccatgagcgccctggtgatcggcagcagcgaggagctgtacaagctggacgagctgcccgacgacatgatcgacatggccgagaaggtgaacctgtactacctggtgatcgtgctgaactacagcgccacctggggcctgctgctgctgatgggcatcctggccctgctgttcaagaagtaccagcacatcttcctgaactactacgccatgtactgcaccgagtgcgacatgtaccacgacaagaaggagctgacctacaacggcgacagccccaccaacgcctggcagtgcacctgcggccagtacgaggacgccaccggcctgatcgtgcaccagaagagctacaactgcctggtgaagtacaaggtgaagtggatcaagaacatcctgatcatgtacatcgtgctgaccctgatcaaggacagcgtgctgatcgccagcgccgagggccccgacttcgccacctgcatcgaggagaagaccatcacctggaactgcaccggccccttcctgaacctgggcagatgcgacaagacccagaagaagaccgactacgccaccatcgccagccagctgaagggcatcgacgccatcagcatcctggacgtgcccatgatcagcaagatccccgaggacatcagcggcgccctgaagtacatcgagagcctgaagacctaccacgagcagctgaccgccgagtacgccatgttcaccagatactgcgactactacacccagttcagcgacaacagcggctacagccagaccacctggagaacctacctgagaagccacgacttcgaggtgtgcatcgcctaccccaaccagcacttctgcagatgcgtgaagaacggcgagaagtgcagcagcgcccagtgggacttcgccaccgagatcaagggctactacaccggcagacagaacaagttcaacaaggacctgaacctggccctgatgaccttccacaccgccttcagaggcaccgccaccagctacgtgaccgagctgatcagcaagggcaagaacagcagcctgctgatgtacgccagcgccatcaagagcaagttcaacggcaacgccctgctgaaggccctgctggacttcatgatgtacctgcagagcctgggcgagatcagcggcttcaagctgaccgacgagtgggaggacttcaagtacgaggaggagcccaccgagcagaccctgatgcccagaggccacagaggcggccagtacaacttcaagaacgccgccagcaacggcaagaccaaggtgtgcaagaacgtgaagaaggtgctgtgcctgagccccagaagcagagccaccttcgacgacgtgatcgcctgcggcgagcacgccaaccccagcgtgtacatgatccccaacaccaccatctaccagagcaacaccgagagaagccactactgcatcgccgacagccactgcctggaggagtacgagctggtgaagcccgagctgctgaccgccctgaagaagagcagatgctgggccggcgacatcgacaccatcgtgctgcacaagcagagcgacggcctgagaagctgcagaatcaaggacaccggcagctgcaacgtgatgggcaacgactggaccatcgtgctgtgcgaggacaacaagtactactacagcgaggtgcaccaggactacgacaaggaccaggacgtgggccacttctgcctgagccccagatgcaacaccatcagataccccatcagccccagacacatcaacagctgcaagtggcagatcagccacagcaccatcggcaagatcagcgtgcacgagctggccgacatcgagcagtacaagaaggccatcagccagaagctgcagaccagcctgagcatcttcaagtacgccaagaccaagaacctgccccacatcaagcccgtgtacaagtacatcgccatcgagggcaccgagaccgtggagggcgtggagaacgccttcatcgagagcgagatccccgccctggccggcaccgccatcggcttcaagatcaacagcaaggagggctaccacctgatggacatcatcggctacgtgaagagcgccagctacagcagcacctacaccaagctgtacaccaccggccccaccatcggcatcaacaccaagcacgacgagaagtgcaccggcagctgccccggcaccatccaccacaagaccggctggctgaccttcagcaaggagagaaccagcacctggggctgcgaggagttcggctgcctggccgtgagcgacggctgcgtgtacggcagctgccaggacatcatcaaggacgagctgaccgtgtacagaaagatcagcgacgaggtgaccgaggtggagctgtgcctgaccttcagcgacaagacctactgcaccaacctgaacgccgtgacccccatcatcaccgacaagttcgaggtgcagttcaagaccgtggagagctacagcctgcccagaatcgtgggcgtgagaaaccacaagatccagatcggccagatcaacgacatcggcgtgtacagcaagggctgcggcaacgtgcagaaggtgaacggcaccaactacggcaacggcgtgcccaagttcgactacctgtgccacctggccagcagaaaggaggtgatcatcagaaagtgcttcgacaacgactaccaggcctgcaagttcctgcagacccccgccagctacagactggaggagcaccagggcaccgtgaccatcatcaactacaagaagatcctgggcagcatcaagatgaagccctactgggtgatgctgagatacaagaactacgccaacagcctggacatcaacgccgagggcacctgcagcggctgcgtgggctgcttcgagaacatccactgcgagttcaccatccacaccaccatcgaggccagctgccagatcgagagcgactgcaccaccttccacgacagaatcctggtgacccccaacgagcacaagtacgccctgaaggtgatctgccacgacaagcccaagaccatcttcaacttcaagatctgcaacaccgagatcgaggccgccatcgccatcgtggacgccaagcccatcatcgagctggcccccgtggaccagaccgcctacatcagagagaaggacgagagatgcaagacctggatgtgcagagtgagagacgagggcatccaggtgctgctggagcccttcaagaacctgttcggcagctacatcggcatcttctacaccatcctgatcgtgatcttcatcctggtgatcatcatctacatcatcctgcccatctgcttcaagctgcaggacaccctgaagcagcacgaggacgcctacaagagagagatgaagatcagatga

SEQ ID NO: 9321 - RNA, 4329 nt, synthetic construct
  misc_feature 1..4329: note = derived and/or modified CDS sequence (opt4) from SDNV(BeAr103645)__KX817334.1__GP
  source 1..4329: mol_type = other RNA
atgatctgcatcctgctgctgatcgccctggccagcgccagccccgtgtaccagagatgcttccaggacggcgccatcgtgaagcagtaccccgccaaggacgccgtgaccgaggtgtgcctgaaggacgacgtgagcatgatcaagacccaggccaactacatgaagaacaccaccggcaccttcagcaacaacgtggccatgagaaagtggctggtggccgactggcacgactgcagaccccagaagagcagcggcggccacatcaacgtgatcgaggtgggcgacgacctgagcctgcacaccgaggcctacatctgcagcgccgactgcgtgatcagcatcgacaaggagaccgcccagatcagactgcagaccgacagcaccaaccacttcgaggtgagcggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatggccaacagcatctgccagaacatcgagatcatcatcctggtgaccctgaccctgatgatcttcatcctgctgaccatcatcagcaagacctacatctgctacatcctgatgcccatcttcatccccatcgcctacatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagaagcagcggcctgtgccccggctacaagagcctgagagccgccagagtgatgtgcaagagcagaggccccgccagcatcctgagcatcctgaccgccgtgctgatcctgaccttcgtgacccccatgagcgccctggtgatcggcagcagcgaggagctgtacaagctggacgagctgcccgacgacatgatcgacatggccgagaaggtgaacctgtactacctggtgatcgtgctgaactacagcgccacctggggcctgctgctgctgatgggcatcctggccctgctgttcaagaagtaccagcacatcttcctgaactactacgccatgtactgcaccgagtgcgacatgtaccacgacaagaaggagctgacctacaacggcgacttcaccaacaagtgcagacagtgcacctgcggccagtacgaggacgccaccggcctgatcgtgcaccagaagagctacaactgcctggtgaagtacaaggtgaagtggatcaagaacatcctgatcatgtacatcatcctgaccctgatcaaggacagcgtgctgatcgccagcgccgagggccccgacttcgccacctgcatcgaggagaagaccatcacctggaactgcaccggccccttcctgaacctgggcagatgcgacaagacccagaagaagaccgactacgccaccatcgccagccagctgaagggcatcgacgccatcagcatcctggacgtgcccatgatcagcaagatccccgaggacatcagcggcgccctgaagtacatcgagagcctgaagacctaccacgagcagctgaccgccgagtacgccatgttcaccagatactgcgactactacacccagttcagcgacaacagcggctacagccagaccacctggagaacctacctgagaagccacgacttcgaggtgtgcatcgcctaccccaaccagcacttctgcagatgcgtgaagaacggcgagaagtgcagcagcgcccagtgggacttcgccaccgagatcaagggctactacaccggcaagcagaacaagttcaacaaggacctgaacctggccctgatgaccttccacaccgccttcagaggcaccgccaccagctacgtgaccgagctgatcagcaagggcaagaacagcagcctgctgatgtacgccagcgccatcaagagcaagttcaacggcaacgccctgctgaaggccctgctggacttcatgatgtacctgcagagcctgggcgagatcagcggcttcaagctgaccgacgagtgggaggacttcaagtacgaggaggagcccaccgagcagaccctgatgcccagaggccacagaggcggccagtacaacttcaagaacgccgccagcaacagcaagaccaaggtgtgcaagaacgtgaagaaggtgctgtgcctgagccccagaagcagagccaccttcgacgacgtgatcgcctgcggcgagcacgccaaccccagcgtgtacatgatccccaacaccaccatctaccagagcaacaccgagagaagccactactgcatcgccgacagccactgcctggaggagtacgagctggtgaagcccgagctgctgaccgccctgaagaagagcagatgctgggccggcgacatcgacaccatcgtgctgcacaagcagagcgacggcctgagaagctgcagaatcaaggacaccggcagctgcaacgtgatgggcaacgactggaccatcgtgctgtgcgaggacaacaagtactactacagcgaggtgcaccaggactacgacaaggaccaggacgtgggccacttctgcctgagccccagatgcaacaccatcagataccccatcagccccagacacatcaacagctgcaagtggcagatcagccacagcaccatcggcaagatcagcgtgcacgagctggccgacatcgagcagtacaagaaggccatcagccagaagctgcagaccagcctgagcatcttcaagtacgccaagaccaagaacctgccccacatcaagcccgtgtacaagtacatcgccatcgagggcaccgagaccgtggagggcgtggagaacgccttcatcgagagcgagatccccgccctggccggcaccgccatcggcttcaagatcaacagcaaggagggcaaccacctgatggacatcatcggctacgtgaagagcgccagctacagcagcacctacaccaagctgtacaccaccggccccaccatcggcatcaacaccaagcacgacgagaagtgcaccggcagctgccccggcaccatccaccacaagaccggctggctgaccttcagcaaggagagaaccagcacctggggctgcgaggagttcggctgcctggccgtgagcgacggctgcgtgtacggcagctgccaggacatcatcaaggacgagctgaccgtgtacagaaagatcagcgacgaggtgaccgaggtggagctgtgcctgaccttcagcgacaagacctactgcaccaacctgaacgccgtgacccccatcatcaccgacaagttcgaggtgcagttcaagaccgtggagagctacagcctgcccagaatcgtgggcgtgagaaaccacaagatccagatcggccagatcaacgacatcggcgtgtacagcaagggctgcggcaacgtgcagaaggtgaacggcaccaactacggcaacggcgtgcccaagttcgactacctgtgccacctggccagcagaaaggaggtgatcatcagaaagtgcttcgacaacgactaccaggcctgcaagttcctgcagacccccgccagctacagactggaggagcaccagggcaccgtgaccatcatcgactacaagaagatcctgggcagcatcaagatgaaggccatcctgggcgacgtgagatacaagaactacgccaacagcctggacatcaacgccgagggcacctgcgccggctgcgtgggctgcttcgagaacatccactgcgagttcaccatccacaccaccatcgaggccagctgccagatcgagagcgactgcaccaccttccacgacagaatcctggtgacccccaacgagcacaagtacgccctgaaggtgatctgccacgacaagcccaagaccatcctgaacttcaagatctgcaacaccaagatcgaggccgccatcaccatcgtggacgccaagcccatcatcgagctggcccccgtggaccagaccgcctacatcagagagaaggacgagagatgcaagacctggatgtgcagagtgagagacgagggcatccaggtgctgctggagcccttcaagaacctgttcggcagctacatcggcatcttctacaccatcctgatcgtgatcttcatcctggtgatcatcatctacatcatcctgcccatctgcttcaagctgcaggacaccctgaagcagcacgaggacgcctacaagagagagatgaagatcagatga

SEQ ID NO: 9322 - RNA, 4326 nt, synthetic construct
  misc_feature 1..4326: note = derived and/or modified CDS sequence (opt4) from SSHV__EU262553.1__GP
  source 1..4326: mol_type = other RNA
atgatctgcatcctgatcctgttcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcaagaacgccaccggcgtgttcagcaacaacgtggccatcagaaagtggctggtgagcgactggcacgactgcagacccaagaagatcaccggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcgtgctgagcaagacctacatctgctacctgctgatgcccgtgttcatccccatcgcctacgcctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcgtgatcaccgccatcctgatcctgaccttcgtgacccccatcaacagcatggtggtgggcgagagcaaggaggtgttcgagctggagcagctgcccgacgacatgctggacatggccctgagaatcaacttctactacttcgtgtgcatcatgaactacgccgtgacctggggcctgatcatcatcggcctgctgatcggcctgctgttcaagaagtaccagcacagattcagcaacctgtacgccatgtactgcgaggagtgcgacatgtaccacgacagaagcggcctgaagagaaacggcgacttcaccaacaagtgcagacagtgcacctgcggccagtacgaggacgccaccggcctgatgacccacagaaagacctacaactgcctggtgagatacaaggccaagtgggtgatgaacttcctgatcgcctacatgctgctgaccctgatcaaggacagcgccatcgtggtgcaggccgccggcaccgacttcaccacctgcctggagaccgagaacatcaactggaactgcaccggccccttcctgaacctgggcaactgccagaagcagcagaagaaggagccctacgccaacatcgccacccagctgaagggcctgcaggccatcagcgtgctggacatgcccatgatcgccagcatccccgaggacatcgccggcgccctgagatacatcgaggagaaggagaccttccacgtgcagctgaccgccgagtacgccatgctgagcagatactgcgactactacgcccagttcagcgacaacagcggctacagccagaccacctggagagtgtacctgagaagccacgacttcgacgcctgcatcctgtaccccaaccagcacttctgcagatgcgtgaagcacggcgacaagtgcagcagcagcaacagagacttcgccaacgagatgaagaactactacagcggcaagcagaacaagttcgacaaggacctgaacctggccctgatggccctgcaccacgccttcagaggcaccagcagcgcctacatcgccaccatgctgagcaagaagagcaacgacgacctgatcgcctacaccaacaagatcaaggagaagttccccggcaacgccctgctgaaggccatcgtggactacatcgcctacatgaagagcctgagcgagatgagcagcttcaagtacgacgagttctgggacgacctgctgtacaagagcgcccccaccaaggcccccagcctgagcagaggcagcgagcccagctacaacttcaagctggtggtgagcagcagaagcatcaagagctgcaagaacgtgaagagcgtggtgtgcctgagccccagaagcggcgtgagctacgacagcatcatcgcctgcggcgaccccaacggccccagcgtgtacagaaagcccagcgacggcgtgttccagagcaacgccgaccagagcacctactgcctggccgacagccactgcctggaggacttcgaggtggtgagccaggaggagctggacgccatcaagaagagcaagtgctgggaggccgagtaccccgacgtgaagctgagcaagctgaccgacggcgtgaagagctgcagaatgaaggacagcggcaactgcaacgtggccgccaacagatggcccatcatccagtgcgagaacgacaagttctactacagcgagctgcagaaggactacgacaagacccaggacatcggccacttctgcctgagccccggctgcagcaccgtgagattccccatcaaccccaagcacatcagcaactgcaactggcaggtgagcagaagcagcatcgccaagatcgacgtgcacaacatcgaggacatcgaccagtacagaaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaccagcaaggagggcaagcacctgctggacgtgatcggctacgtgaagagcgccagctacagcagcatctacaccaagctgtacaccaccggccccaccagcggcatcaacaccaagcacgacgagctgtgcaccggcccctgccccgccaagatcaaccaccagaccggctggctgaccttcgccaaggagagaaccagcagctggggctgcgaggagttcggctgcctggccatcagcgacggctgcgtgttcggcagctgccaggacatcatcagagacgagctgaccgtgtacagaaaggagaccgacgaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgagatcaagatcggccaggtgaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagagccccgccagctacagactggaggaggacagcggcaccgtgaccgtgatcgactacaagaagatcctgggcaccatcaagatgaaggccatcctgggcgacgtgaagtacaagaccttcgccgacaacgtggacatgaccgccgagggcagctgcaccggctgcatcaactgcttcgagaacatccactgcgagctgaccctgcacaccaccatcgaggccagctgccccatcgtgagcacctgcaccgtgttccacgacagaatcctggtgacccccaacgagcacaagtacgccctgaaggtggtgtgcaccgagaagcccggcaacaccctgaccatcagaatctgcaacaccaaggtggaggccagcctggccctggtggacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgccctgctgatcatcatctacatcgtgctgcccatctgcttcaagctgagagacaccctgagaaagcacgaggacgcctacaagagagagatgaagatcagatga

SEQ ID NO: 9323 - RNA, 4326 nt, synthetic construct
  misc_feature 1..4326: note = derived and/or modified CDS sequence (opt4) from SSHV__K02539.1__GP
  source 1..4326: mol_type = other RNA
atgatctgcatcctgatcctgttcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcaagaacgccaccggcgtgttcagcaacaacgtggccatcagaaagtggctggtgagcgactggcacgactgcagacccaagaagatcaccggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccatcgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcgtgctgagcaagacctacatctgctacctgctgatgcccgtgttcatccccatcgcctacgcctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcgtgatcaccgccatcctgatcctgaccttcgtgacccccatcaacagcatggtggtgggcgagagcaaggaggtgttcgagctggagcagctgcccgacgacatgctggacatggccctgagaatcaacttctactacttcgtgtgcatcatgaactacgccgtgacctggggcctgatcatcatcggcctgctgatcggcctgctgttcaagaagtaccagcacagattcagcaacctgtacgccatgtactgcgaggagtgcgacatgtaccacgacagaagcggcctgaagagaaacggcgacttcaccaacaagtgcagacagtgcacctgcggccagtacgaggacgccaccggcctgatgacccacagaaagacctacaactgcctggtgagatacaaggccaagtgggtgatgaacttcctgatcgcctacatgctgctgaccctgatcaaggacagcgccatcgtggtgcaggccgccggcaccgacttcaccacctgcctggagaccgagaacatcaactggaactgcaccggccccttcctgaacctgggcaactgccagaagcagcagaagaaggagccctacgccaacatcgccacccagctgaagggcctgcaggccatcagcgtgctggacatgcccatgatcgccagcatccccgaggacatcgccggcgccctgagatacatcgaggagaaggagaccttccacgtgcagctgaccgccgagtacgccatgctgagcagatactgcgactactacgcccagttcagcgacaacagcggctacagccagaccacctggagagtgtacctgagaagccacgacttcgacgcctgcatcctgtaccccaaccagcacttctgcagatgcgtgaagagaggcgacaagtgcagcagcagcaacggcgacttcgccaacgagatgaagaactactacagcggcaagcagaacaagttcgacaaggacctgaacctggccctgatggccctgcaccacgccttcagaggcaccagcagcgcctacatcgccaccatgctgagcaagaagagcaacgacgacctgatcgcctacaccaacaagatcaaggagaagttccccggcaacgccctgctgaaggccatcgtggactacatcgcctacatgaagagcctgagcgagatgagcagcttcaagtacgacgagttctgggacgacctgctgtacaagagcgcccccaccaaggcccccagcctgagcagaggcagcgagcccagctacaacttcaagctggtggtgagcagcagaagcatcaagagctgcaagaacgtgaagagcgtggtgtgcctgagccccagaagcggcgtgagctacgacagcatcatcgcctgcggcgaccccaacggccccagcgtgtacagaaagcccagcgacggcgtgttccagagcaacgccgaccagagcacctactgcctggccgacagccactgcctggaggacttcgaggtggtgagccaggaggagctggacgccatcaagaagagcaagtgctgggaggccgagtaccccgacgtgaagctgagcaagctgaccgacggcgtgaagagctgcagaatgaaggacagcggcaactgcaacgtggccgccaacagatggcccatcatccagtgcgagaacgacaagttctactacagcgagctgcagaaggactacgacaagacccaggacatcggccacttctgcctgagccccggctgcagcaccgtgagattccccatcaaccccaagcacatcagcaactgcaactggcaggtgagcagaagcagcatcgccaagatcgacgtgcacaacatcgaggacatcgaccagtacagaaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaccagcaaggagggcaagcacctgctggacgtgatcggctacgtgaagagcgccagctgcagcagcatctacaccaagctgtacaccaccggccccaccagcggcatcaacaccaagcacgacgagctgtgcaccggcccctgccccgccaagatcaaccaccagaccggctggctgaccttcgccaaggagagaaccagcagctggggctgcgaggagttcggctgcctggccatcagcgacggctgcgtgttcggcagctgccaggacatcatcagagacgagctgaccgtgtacagaaaggagaccgacgaggtgaccgacgtggagctgtgcctgaccttcagcgacaagacctactgcaccaacctgaaccccatcacccccatcatcaccgacctgttcgaggtgcagttcaagaccgtggagacctacagcctgcccagaatcgtggccatccagaaccacgagatcaagatcggccaggtgaacgacctgggcgtgtacagcaagggctgcggcaacgtgcagaaggtgaacggcaccgtgtacggcaacggcgtgcccaagttcgactacctgtgccacctggccagcagaaaggaggtgatcgtgagaaagtgcttcgacaacgactaccaggcctgcaagttcctgcagagccccgccagctacagactggaggaggacagcggcaccgtgaccgtgatcgactacaagaagatcctgggcaccatcaagatgaaggccatcctgggcgacgtgaagtacaagaccttcgccgacaacgtggacatgaccgccgagggcagctgcaccggctgcatcaactgcttcgagaacatccactgcgagctgaccctgcacaccaccatcgaggccagctgccccatcgtgagcacctgcaccgtgttccacgacagaatcctggtgacccccaacgagcacaagtacgccctgaaggtggtgtgcaccgagaagcccggcaacaccctgaccatcagaatctgcaacaccaaggtggaggccagcctggccctggtggacgccaagcccatcctggagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgccctgctgatcatcatctacatcgtgctgcccatctgcttcaagctgagagacaccctgagaaagcacgaggacgcctacaagagagagatgaagatcagatga

SEQ ID NO: 9324 - RNA, 4335 nt, synthetic construct
  misc_feature 1..4335: note = derived and/or modified CDS sequence (opt4) from SORV__AF123488.1__GP
  source 1..4335: mol_type = other RNA
atggaggtgctgagcctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgagaccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgaccatcgtgagcaagacctacatctgctacctgctgatgcccatcttcatccccatcgccttcatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccatcctgatcctgaccttcgtgacccccatcagcgccatggtggtgggcgagagcaacgagatctacaccctggacgacctgcccgacgacatggtgcagatggccgagagaatcaacatctactaccagatcctgatcatcaactacggcgtgacctgggccttcctgctgctgggcctggtgctggcctacttcttcaagaagtaccagcacaagttcctggactactacgccatgtactgcgaggagtgcgacatgtaccacgagaagagcggcatgacctactggggcgacttcaccaacaagtgcagacagtgcacctgcggccagttcgaggacgccaccggcctgatggtgcacaagaagagctacaactgcctggtgaagtacaaggccaagtggatcagaaacatcctgatcgcctacctgatgatcatgctggtgaaggacagcctgctgttcgtgggcgccaccagagccgacttcgccagctgcgtggacgagaagaccgtgacctggaactgcaccggccccttcctgaacctgggcagatgcgacaagacccagaagaagaccggctacaaggacatcgccaaccagctgaagggcctgggcgtgatcagcatcctggacatccccatgatcgagaagatgcccgacgagatcagcggcagcctgaagtacatcgacagcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagtacgacgacaagtgcaacagcgccaagtgggacttcgccaacgagatgaagaccttctacaccggcagaaaggtgaagttcaacaaggacctgaacctggccctgctggtgctgcacaaggccttcagaggcaccggcaccgcctacatcgccgaggccatggccagaaaggacaacggcagcatggcccacttcgccctggagatcagaaagaagttccccaccaacgccctgctggccgccctgatcgactacatcgtgtacctgcagagcctggccgagatcagcaccttcgagctggaggaggactgggaggacttcaagtacaagcccgagcccaccgagagcaccctgcagcccagaagccacagaagcgaccagtacaacttcaagaacgccgacagcaacagcaacgtgaaggtgtgcaagaacgtgaagaaggtgctgtgcgtgagccccagaagcagagccaagttcgagaacatcatcgcctgcggcgagcacgccaaccccagcgtgtacatgatgcccaacatcagcatctaccagagcaacagcgagagaagccactactgcatcgccgacagccactgcctggaggagtacgagatcgtgaacaccgagctgctgaccgccctgaagaagagcagatgctgggccaaggagatggacgacgtggtgctgcacaagcagagcgacggcctgagaagctgcagaatcaaggacaccggcagctgcaacgtgctgggcaacgactggaccatcgtgctgtgcgagaacggcaactactactacagcgagatccacaaggactacgacaaggaccaggacgtgggccacttctgcctgagccccagatgcagcaccatcagataccccatcaacagaagacacatcagaaagtgcgactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcaccgagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcatcaacaccagacacgacgagaagtgcaccggcccctgccccgtgaccatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagaatcatcgccgtgaagaaccacgagatcaaggtgggccagatcaacgacctgggcgtgtacagcaagggctgcggcaacgtgcagaaggtgaacggcaccaactacggcaacggcgtgcccaagttcgactacctgtgccacctggccagcagaaaggaggtgatcctgagaaagtgcttcgacaacgactaccaggcctgcaagttcctgcagagccccgccagctacagactggaggagcaccagggcaccgtgaccgtgatcgactacaagaagatcctgggcagcatcaagatgaaggccatcctgggcgacgtgaagtacaagaactaccagagcaacatcgagatcaacgccgagggcacctgcgccggctgcgtgaactgcttcgagaacatccactgcgagttcaccatccacaccaccgtggagaccagctgccccatcgtgaccgactgcgtgagcttccacgacagaatcctgatcacccccgacgagcacaagtacgccctgaagatcgtgtgccaggacaagcccaaggtgagcctgaagttcaagatctgcaacaccaacatcgacgccagcatgaccatcgtggacagcaagcccatcctggagctggcccccgtggaccagaccgcctacatcaaggagaaggacgagagatgcaagacctggatgtgcagagtgagagacgagggcttccaggtgatcctggagcccttcaagaacctgttcggcagctacatcggcatcttctacaccggcatcctgagcgtgatctgcctgctgatcgtgatctacatcgtgctgcccatctgcttcaagctgagagacaccctgaagcagcacgaggacgcctacaagaaggagatgaagatcagatga

SEQ ID NO: 9325 - RNA, 4335 nt, synthetic construct
  misc_feature 1..4335: note = derived and/or modified CDS sequence (opt4) from SORV(SORV-252)__JN815081.1__GP
  source 1..4335: mol_type = other RNA
atggaggtgctgagcctgatctggctgctggccgtgtgcagcgccaaccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcagcaacaacgtggccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacagcaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctgatcatcttcatcttcctgaccatcgtgagcaagacctacatctgctacctgctgatgcccatcttcatccccatcgccttcatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccgtgctgatcctgaccttcgtgacccccatcagcgccatcatcatcgacgagagcaaggagatctacaccctggacgacctgcccgacgacatggtgcagatggccgagagaatcaacatctactaccagatcctgctgatcaactacggcgtgacctgggccttcctgctgctgggcctgatcctggcctacttcttcaagaagtaccagcacaagttcctggactactacgccatgtactgcgaggagtgcgacatgtaccacgagaagagcggcatgacctactggggcgacttcaccaacaagtgcagacagtgcacctgcggccagtacgaggacgccgccggcctgatggtgcacaagaagagctacaactgcctgatcaagtacaaggccaagtggatcaagaacatcctgatcctgtacctgatcatgatcctggtgaaggacagcctgctgttcgtgggcgccaccggcaccgacttcgccgcctgcatcgacgagaagagcgtgacctggaactgcaccggccccttcctgaacctgggcagatgcgacaagccccagaagaaggccagcttcaaggacatcgccaaccagctgaagggcctgggcgtgatcagcgtgctggacatccccatgatcgagaagatgcccgacgacatcagcggcagcctgaagtacatcgacagcctgagaacctaccacgagcagctgaccgccgagtacgccttcctgaccagatactgcgactactacgcccagtacaccgacaacagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagagcttctacaccggccagaaggccaagttcaacaaggacctgaacctggccctgctggtgctgcacaaggccttcagaggcaccggcaccgcctacatcgccgagaccctggccagaaaggacaacggcagcatggtgcacttcgccctggagatcagaaagaagttccccaccaacgccctgctggccgccctgatcgactacatcgtgtacctgcagagcctggccgagatcagcaccttcgagcccgaggaggactgggaggacagcaagtaccagcccgagcccaccgagagcgtgctgcagcccagagcccacagaagcgaccagtacaacttcaagaacgccgacagcaacagcaacgtgaaggtgtgcaagaacatcaagaaggtgctgtgcatcagccccagaagcagagccaagttcgagaacatcatcgcctgcggcgagcacgccaaccccagcgtgtacatgatgcccaacaccagcatctaccagagcaacagcgagagaagccactactgcatcgccgacagccactgcctggaggagtacgagatcgtgaacaccgagctgctgaccgccttcaagaagagcagatgctgggccaaggagatcgacgacatcgtgctgcacaagcagagcgacggcctgagaagctgcagaatcaaggacaccggcagctgcaacgtgctgggcaacgactggaccatcgtgctgtgcgagaacggcaactactactacagcgaggtgcacaaggactacgacaaggaccaggacgtgggccacttctgcctgagccccagatgcaacaccatcagataccccatcagcagaagacacatcggcgagtgcaactggcagatcacccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacagatacatcaccgtgggcggcaccgagaccatcgagggcgtggagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcatcaacaccaagcacgacgagaagtgcaccggcagctgccccgtgaccatcaaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccgacctgaacgccatcacccccatcatcaccgacaagttcgaggtgcagttcaagaccgtggagagctacaccctgcccagaatcatcgccgtgaagaaccacgagatcagaaccggccagatcaacgacctgggcgtgtacagcaagggctgcggcaacgtgcagaaggtgaacggcaccagctacggcaacggcgtgcccaagttcgactacctgtgccacctggccagcagaaaggaggtgatcctgagaaagtgcttcgacaacgactaccaggcctgcaagttcctgcagagccccgccagctacagactggaggagcaccagggcaccgtgaccgtgatcgactacaagaagatcctgggcagcatcaagatgaaggccatgctgggcgacgtgaagtacaagaactaccagagcaacatcgagatcaacgccgagggcacctgcgccggctgcatcgactgcttcgagaacatccactgcgagttcaccatccacaccaccgtggaggccagctgccccatcaccaccgactgcgtgagcttccacgacagaatcctgatcacccccgaggagcacaagtacgccctgaagatcgtgtgccaggacaagcccaaggtgagcctgaagttcaagatctgcaacaccaacgtggaggccagcatgaccatcatcgacagcaagcccatcctggagctggcccccgtggaccagaccacctacatcaaggagaaggacgagagatgcaagacctggatgtgcagagtgagagacgagggcttccaggtgatcctggagcccttcaagaacctgttcggcagctacatcggcatcttctacaccggcgtgctgagcatcatctgcctgctgatcgtgatctacatcatcctgcccatctgctacaagctgagagacaccctgaagcagcacgaggacgcctacaagaaggagatgaagatcagatga

SEQ ID NO: 9326 - RNA, 4335 nt, synthetic construct
  misc_feature 1..4335: note = derived and/or modified CDS sequence (opt4) from SORV(NJO-94F)__KX817337.1__GP
  source 1..4335: mol_type = other RNA
atggaggtgctgagcctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgagaccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgaccatcgtgagcaagacctacatctgctacctgctgatgcccatcttcatccccatcgccttcatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccatcctgatcctgaccttcgtgacccccatcagcgccatggtggtgggcgagagcaacgagatctacaccctggacgacctgcccgacgacatggtgcagatggccgagagaatcaacatctactaccagatcctgatcatcaactacggcgtgacctgggccttcctgctgctgggcctggtgctggcctacttcttcaagaagtaccagcacaagttcctggactactacgccatgtactgcgaggagtgcgacatgtaccacgagaagagcggcatgacctactggggcgacttcaccaacaagtgcagacagtgcacctgcggccagttcgaggacgccaccggcctgatggtgcacaagaagagctacaactgcctggtgaagtacaaggccaagtggatcagaaacatcctgatcgcctacctgatgatcatgctggtgaaggacagcctgctgttcgtgggcgccaccagagccgacttcgccagctgcgtggacgagaagaccgtgacctggaactgcaccggccccttcctgaacctgggcagatgcgacaagacccagaagaagaccggctacaaggacatcgccaaccagctgaagggcctgggcgtgatcagcatcctggacatccccatgatcgagaagatgcccgacgagatcagcggcagcctgaagtacatcgacagcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggcagaaaggtgaagttcaacaaggacctgaacctggccctgctggtgctgcacaaggccttcagaggcaccggcaccgcctacatcgccgaggccatggccagaaaggacaacggcagcatggcccacttcgccctggagatcagaaagaagttccccaccaacgccctgctggccgccctgatcgactacatcgtgtacctgcagagcctggccgagatcagcaccttcgagctggaggaggactgggaggacttcaagtacaagcccgagcccaccgagagcaccctgcagcccagaagccacagaagcgaccagtacaacttcaagaacgccgacagcaacagcaacgtgaaggtgtgcaagaacgtgaagaaggtgctgtgcgtgagccccagaagcagagccaagttcgagaacatcatcgcctgcggcgagcacgccaaccccagcgtgtacatgatgcccaacatcagcatctaccagagcaacagcgagagaagccactactgcatcgccgacagccactgcctggaggagtacgagatcgtgaacaccgagctgctgaccgccctgaagaagagcagatgctgggccaaggagatggacgacgtggtgctgcacaagcagagcgacggcctgagaagctgcagaatcaaggacaccggcagctgcaacgtgctgggcaacgactggaccatcgtgctgtgcgagaacggcaactactactacagcgagatccacaaggactacgacaaggaccaggacgtgggccacttctgcctgagccccagatgcagcaccatcagataccccatcaacagaagacacatcagaaagtgcgactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcaccgagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcatcaacaccagacacgacgagaagtgcaccggcccctgccccgtgaccatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagaatcatcgccgtgaagaaccacgagatcaaggtgggccagatcaacgacctgggcgtgtacagcaagggctgcggcaacgtgcagaaggtgaacggcaccaactacggcaacggcgtgcccaagttcgactacctgtgccacctggccagcagaaaggaggtgatcctgagaaagtgcttcgacaacgactaccaggcctgcaagttcctgcagagccccgccagctacagactggaggagcaccagggcaccgtgaccgtgatcgactacaagaagatcctgggcagcatcaagatgaaggccatcctgggcgacgtgaagtacaagaactaccagagcaacatcgagatcaacgccgagggcacctgcgccggctgcgtgaactgcttcgagaacatccactgcgagttcaccatccacaccaccgtggagaccagctgccccatcgtgaccgactgcgtgagcttccacgacagaatcctgatcacccccgacgagcacaagtacgccctgaagatcgtgtgccaggacaagcccaaggtgagcctgaagttcaagatctgcaacaccaacatcgacgccagcatgaccatcgtggacagcaagcccatcctggagctggcccccgtggaccagaccgcctacatcaaggagaaggacgagagatgcaagacctggatgtgcagagtgagagacgagggcttccaggtgatcctggagcccttcaagaacctgttcggcagctacatcggcatcttctacaccggcatcctgagcgtgatctgcctgctgatcgtgatctacatcgtgctgcccatctgcttcaagctgagagacaccctgaagcagcacgaggacgcctacaagaaggagatgaagatcagatga

SEQ ID NO: 9327 - RNA, 4323 nt, synthetic construct
  misc_feature 1..4323: note = derived and/or modified CDS sequence (opt4) from TAHV__AF123485.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggtggacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcaaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatggaggacctgaccgagatgaacaacttcaagcacgacgagatgtgggacgacttcatcttcgaggtgccccccaccaagagccccagcatcagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcctggagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9328 - RNA, 4323 nt, synthetic construct
  misc_feature 1..4323: note = derived and/or modified CDS sequence (opt4) from TAHV__AF229129.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacggcgacgccgccggcctgctgacccacagaaagacctacaactgcctggtgcagtacaagagcaagtggctgaccaacttcctgatcggctacatcatcctgatgctgatcaaggacagcgtgctgctggtgcacgccgacggcaccgacttcgagaagtgcagcggcgaggccgacatcacctggaactgcaccggccccttcctgagcctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaacagacacttctgcagatgcgtgaagcacggcgacaagtgcagcagcagcaactgggacttcgccaacgagatgaagaactactacagcggcaagcagagcaagttcaacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaagggcctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacacccagctgaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgaaccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgcccccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcgtgaactgcttcgagaacatccactgcgagagcaccatccacagcaccgtggaggccagctgccccgtgatcagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggtggagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9329 - RNA, 4323 nt, synthetic construct
  misc_feature 1..4323: note = derived and/or modified CDS sequence (opt4) from TAHV(22595-6)__HM036218.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccaccctgagagtgtacctgagaagccacgacttcaaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatggaggacctgaccgagatgaacaacttcaagcacgacgagatgtgggacgacttcatcttcgaggtgccccccaccaagagccccagcatcagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcgagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9330 - RNA, 4323 nt, synthetic construct
  misc_feature 1..4323: note = derived and/or modified CDS sequence (opt4) from TAHV(92' Bardos)__HM036209.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacaacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacgaggacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatcagcatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaacttctacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatggaggacctgaccgagatgaacaacttcaagtacgacgagatgtgggacgacttcatcttcgaggtgccccccaccaagagccccagcatcagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9331 - RNA, 4323 nt, synthetic construct
  misc_feature 1..4323: note = derived and/or modified CDS sequence (opt4) from TAHV(92' Bardos)__HM036212.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccatcaagctggaggacctgcccgacgacatgctgagcaccgccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacgaggacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatcagcatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcaaggcctgcatcctgtaccccaaccagcacttctgcagatgcgtgaagcacggcgacaagtgcagcagcagcaactgggacagcgccaacgagatgaagaacttctacagcggcaaccagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatggaggacctgaccgagatgaacaacttcaagtacgacgagatgtgggacgacttcatcttcgaggtgccccccaccaagagccccagcatcagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9332 - RNA, 4323 nt, synthetic construct
  misc_feature 1..4323: note = derived and/or modified CDS sequence (opt4) from TAHV(Souche D C14019-29)__HM036215.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcaagaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcgaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaacagacacttctgcagatgcgtgaagcacggcgacaagtgcagcagcagcaactgggacttcgccaacgagatgaagaactactacagcggcaagcagagcaagttcaacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggaggacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtggccaccaacagatggcccatcatcctgtgcgacaacaacaagttctactacagcgagctgcaggaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccatcctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagatcagagacaccctgagacagcacgaggacgcctacaagagagagatgaagatcagatga

SEQ ID NO: 9333 - RNA, 4323 nt, synthetic construct
  misc_feature 1..4323: note = derived and/or modified CDS sequence (opt4) from TAHV(1014)__GQ386833.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggcaagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgagagagaagaagaacgaggacctggtgacctacgtggagaagatcaagggcaagtaccccggcaacgccctgctgaaggccatcatcgactacatcaagtacatgaagggcctgaccgagatgaacaacagcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaacttcgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaagggccaggacatcggccacttctgcctgagccccagatgcaacaccatcagacaccccatcaacagaaagcacatcagcaactgcacctggcaggtgaaccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcatcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9334 - RNA, 4323 nt, synthetic construct
  misc_feature 1..4323: note = derived and/or modified CDS sequence (opt4) from TAHV(105)__GQ386829.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9335 - RNA, 4323 nt, synthetic construct
  misc_feature 1..4323: note = derived and/or modified CDS sequence (opt4) from TAHV(106)__GQ386830.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaagggcctgaccgagatgaacaacttcaagcacgacgagatgtgggacgacttcatcagcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcgacgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9336 - RNA, 4323 nt, synthetic construct
  misc_feature 1..4323: note = derived and/or modified CDS sequence (opt4) from TAHV(181)__GQ386831.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacggcgacgccgccggcctgctgacccacagaaagacctacaactgcctggtgcagtacaagagcaagtggctgaccaacttcctgatcggctacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaacagacacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaagggcctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgaaccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9337 - RNA, 4323 nt, synthetic construct
  misc_feature 1..4323: note = derived and/or modified CDS sequence (opt4) from TAHV(236)__GQ386832.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccatcacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatgcccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtgatctgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagctgaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcagcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacgccctgagacagcacgaggacgcctacaagagagagatgaagatcagatga

SEQ ID NO: 9338 - RNA, 4323 nt, synthetic construct
  misc_feature 1..4323: note = derived and/or modified CDS sequence (opt4) from TAHV(29)__GQ386823.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacgacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacatgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgtggccatgaccctggccgacgccaagcccatcctggagctggcccccgtggaccagaccacctacatcaaggagaaggacgagagatgcaagacctggatgtgcagagtgaaggacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9339 - RNA, 4323 nt, synthetic construct
  misc_feature 1..4323: note = derived and/or modified CDS sequence (opt4) from TAHV(4019)__GQ386834.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaacagacacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacagcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgaggccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcagctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggatcaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9340 - RNA, 4323 nt, synthetic construct
  misc_feature 1..4323: note = derived and/or modified CDS sequence (opt4) from TAHV(4020)__GQ386835.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtacagcggcaacgccctgctgaaggccatcatcgactacatcaagtacatgaagggcctgaccgagatgaacaacttcaagcacgacgagatgtgggacgacttcatcttcgaggtgcccccccccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9341 - RNA, 4323 nt, synthetic construct
  misc_feature 1..4323: note = derived and/or modified CDS sequence (opt4) from TAHV(4030)__GQ386836.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgcaacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctgatcacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcatcgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcgtgaactgcttcgagaacatccactgcgagctgaccatccacagcaccgtggaggccagctgcagcgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9342 - RNA, 4323 nt, synthetic construct
  misc_feature 1..4323: note = derived and/or modified CDS sequence (opt4) from TAHV(4033)__GQ386837.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacggcttcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgagcctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9343 - RNA, 4323 nt, synthetic construct
  misc_feature 1..4323: note = derived and/or modified CDS sequence (opt4) from TAHV(4034)__GQ386838.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacaccctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcatcctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatgctgcgactactacacccagttcaccgacaacagcggctacagccagaccacctggagagtgtacctgagaagccacgacttcgaggcctgcatcctgtaccccaaccagcacttctgcagatgcgtgaagcacggcaacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacaccgaccagacccacttctgcctgagcgacacccactgcctggagaactacgaggccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgaaccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagatccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9344 - RNA, 4323 nt, synthetic construct
  misc_feature 1..4323: note = derived and/or modified CDS sequence (opt4) from TAHV(4057)__GQ386839.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaagggcagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatcatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacggcgacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacaagtggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcagacacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcgtgaactgcttcgagaacatccactgcgagagcaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9345 - RNA, 4323 nt, synthetic construct
  misc_feature 1..4323: note = derived and/or modified CDS sequence (opt4) from TAHV(4060)__GQ386840.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccatcctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgcagacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacacccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatcgccatcttcatcgtgatctacatcgtgctgcccatctgcttcaagctgagagacaccctgagacagcacgaggacgcctacaagagagagatgaagatcagatga

SEQ ID NO: 9346 - RNA, 4323 nt, synthetic construct
  misc_feature 1..4323: note = derived and/or modified CDS sequence (opt4) from TAHV(5060)__GQ386841.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatcatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacggcgacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgagccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacaagtggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacagcaacatcgacaagatcgaggtgcacgagctggaggacctggagcagtacaagaaggccatcacccagaagctgcagaccagcctgaccctgttcaagtacagcaagaccaagaacctgccccacatcaagcccatctacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9347 - RNA, 4323 nt, synthetic construct
  misc_feature 1..4323: note = derived and/or modified CDS sequence (opt4) from TAHV(76)__GQ386824.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacggcgacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgaggccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcagctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggatcaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9348 - RNA, 4323 nt, synthetic construct
  misc_feature 1..4323: note = derived and/or modified CDS sequence (opt4) from TAHV(83)__GQ386825.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggtgtgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaagggcctgaccgagatgaacaacttcaagcacgacgaggtgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9349 - RNA, 4323 nt, synthetic construct
  misc_feature 1..4323: note = derived and/or modified CDS sequence (opt4) from TAHV(89)__GQ386826.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcggctacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaagggcctgaccgagatgaacaacttcaagcacgacgagatgtgggacgacttcatcttcggcgtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgaaccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacagcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccgtgacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgccgacctgaccgtggagggcgtgtgcaccggctgcatcaactgcttcgagaacatccactgcgagctgaccatccacagcaccgtggaggccagctgccccgtggtgagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaagggcgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9350 - RNA, 4323 nt, synthetic construct
  misc_feature 1..4323: note = derived and/or modified CDS sequence (opt4) from TAHV(90)__GQ386827.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtggccggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctgaccaacttcctgatcggctacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacatcaagtacatgaagggcctgaccgagatgaacaacttcaagcacgacgagatgtgggacgacttcatcttcgaggtgccccccaccaagagccccagcgtgagaagactggagagcagctacgacttcaagaccgacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacaacaagttctactacagcgagctgcagaaggactacgacaaggaccaggacatcggccacttctgcctgagccccagatgcaacaccatcagacaccccatcaacagaaagcacatcagcaactgcacctggcaggtgaaccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccgtgacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtggtgagcagctgcaccgccttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9351 - RNA, 4323 nt, synthetic construct
  misc_feature 1..4323: note = derived and/or modified CDS sequence (opt4) from TAHV(94)__GQ386828.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcagaaacgccaccggcacctacgccaacaacgtggccatcagaaagtggctggtgagcgactggcacgactgcagacccaagaaggtgagcggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacatctacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaaggtgaacatgtactacatcatgtgcatgatcaactacgccgtgacctggagcttcatcctgtgcgccctgctgatcgccctgctgttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccgccctgctgacccacagaaagacctacaactgcctggtgcagtacaagagcaagtggctgaccaacttcctgatcgtgtacatcatcctgatgctgatcaaggacagcgtgctgatcgtgcacgccgacggcaccgacttcgagaagtgcagcggcgaggccgacatcacctggaactgcaccggccccttcctgaacctgggcaactgcgagaagaagcagaagaaggagagctacaacaacatcgccacccagctgaagggcctggacgccatcagcgtgctggacatccccatgatcagcaagatccccgaggacatcgccggcgccctgagattcatcgaggagcagagaagctaccacgtgcagctgaccgccgagtacgccatgctgaccagatactgcgactactacacccagttcaccgacaacagcggctacagccagaccacctggagagtgtacctgagaagccacgacttcgaggtgtgcatcctgtaccccaaccagcacttctgcagatgcgtgaagcacggcgacaagtgcagcagcagcaactgggacttcgccaacgagatgaagaactactacagcggcaagcagagcaagttcgacaaggacctgaacctggccctgatgagcctgcaccacgccttcagaggcaccagcagcttctacatcgccaagctgctgaaggagaagaagaacgaggacctggtgacctacgccgagaagatcaagggcaagtaccccggcaacgccctgctgaaggccatcatcgactacgtgaagtacatgaaggacctgaccgagatgaacaacttcaagcacgacgagatgtgggacgacttcatcttcgaggtgccccccaccaagagccccagcgtgagaagactggagagcagctacgacttcaagaccaacgtgaacagcaaccccagccacatctgcaagaacatcaagaccgtggtgtgcctgagccccaagagcggcgtgagctacgacagcatcatcgcctgcggcgagcccagccagcccagcatctacagaaagcccgacagccaggtgttccagagcaacgccgaccagacccacttctgcctgagcgacacccactgcctggagaactacgagaccgtgggcgaggagatcatcgacgccatcaagaagagcaagtgctgggagaccgagttcaccgagtacatccagttcaagcagagcgacggcgtgagaagctgcagaatgaaggacagcggcgagtgcaccgtgaccaccaacagatggcccatcatcctgtgcgacaacgacaagttctactacagcgagctgcagaaggactacgacaaggaccaggacatcggccacttctgcctgagccccagatgcaacaccatcagacaccccatcaacagaaagcacatcagcaactgcacctggcaggtgagccacaacaacatcgacaagatcgaggtgcacgagctggaggacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggacgagatcaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcgtgaactgcttcgagaacatccactgcgagagcaccatccacagcaccgtggaggccagctgccccgtgatcagcagctgcaccgtgttccacgacagaatcctgatcacccccaacgagcacaagtacgccatcaaggtgatctgcaacgagaagcccggccccaccctgcccttcaagatctgcagcgccaagaccgacgccgccatgaccctggccgacgccaagcccatcctggagctggcccccgtggaccagaccacctacatcaaggagaaggacgagagatgcaagacctggatgtgcagagtgagagacgagggcttccaggtgatcttcgagcccttcaagaacctgttcggcagctacatcggcatcttctacaccttcatcatcagcctgatggccatcttcatcgtgatctacatcgtgctgcccatctgcttcaagctgagagacaccctgagacagcacgaggacgcctacaagagagagatgaagatcagatga

SEQ ID NO: 9352 - RNA, 4323 nt, synthetic construct
  misc_feature 1..4323: note = derived and/or modified CDS sequence (opt4) from TAHV(XJ0625)__EU622819.2__GP
  source 1..4323: mol_type = other RNA
atgatgttcgtgctgttcttcatcgccctgagcaccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcaagaacgccaccggcacctacgccaacaacgtggccatcagaaagtggctggtgagcgactggcacgactgcagacccaagaaggtggccggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacctgctgatgcccatcttcatccccctggcctacgtgtacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcgtgatcaccgccgtgctgatcctgaccttcgtgacccccatcaacgccatggtggccggcgacacccaggagaccttcaagctggaggacctgcccgacgacatgctgagcatggccatgaagatccagatgtactacatcatgtgcatcgtgaactacatcgtgacctggagcttcatcgtgtgcgccctgatcatcgccctgatcttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctggtgaacttcctgatcatctacatcctgctgatgctggtgaaggacagcgtgctgatcgtgcaggccgagggcaccgacttcgagaagtgcagcggcgagatcaacatcacctggaactgcaccggccccttcctgaacctgggcaactgcgagaagaagcagaagaaggagccctacagcaacatcgccacccagctgaagggcctggacgccatcagcatcctggacatccccatgatcagcagaatccccgaggacatcgccggcgccctgagattcatcgaggagcagaacagctaccacgtgcagctgaccgccgagtacgccatgctgaccagatactgcgactactacacccagttcagcgacaacagcggctacagccagaagacctggagagtgtacctgagaagccacgacttcgaggcctgcatcctgtaccccaaccagcacttctgcagatgcgtgaagcacggcgacaagtgcagcagcagcaactgggacttcgccagcgagatgaagaactactacaccggcaagcagctgaagttcaacaaggacctgaacctggccctgatgagcttccaccacgccttcagaggcaccagcagcttctacgtggccaagctgctgagagagaagaacaacgaggagctggtgaactacaccgagaagatcaaggacaagtaccccggcaacgccctgctgaaggccatcatcgactacatcaagtacatgaagaacctgagcgagatgaccaacttcaagcacgacgagatgtgggacgacttcgtgttcaacagcccccccaccaagagccccagcgtgagaagaagcgacagcgcctacgacttcaagaacaacatcaacagcaaccccagccacatctgccagaacatcaagaccgtgatctgcctgagccccaagagcggcgtgagctacgacagcatcatcgcctgcggcgagcccagccagcccaccatctacaagaagcccgagagcagagtgttccagagcaacgccgaccagacccacttctgcctggccgacacccactgcctggagaactacgagaccgtgggcgaggagatcctggacgccatcaagaagagcaagtgctgggagaccgacttcaccgagtacatccagttcaagcagagcgacggcgtgagaagctgcagaatgaaggacagcggcgagtgcaccgtgaccacccacagatggcccatcatcctgtgcgacaacaacaagttctactacagcgagctgcagaaggactacgacaaggaccaggacatcggccacttctgcctgagccccagatgcaacaccatcagacaccccatcaaccagaagcacatcagcaactgcacctggcaggtgagccacaacaacatcgagaagatcgaggtgcacgagctggagaacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggaggagctggccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggagagctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtgaccagcagctgcaccgtgttccacgacagaatcctgatcacccccaacgagcacaagtacgccatcaaggtgatctgcgccgagaagcccggccccagcctgcagttcaagatctgcaacgccaagaccgacgccgccatgaccctggccgacgccaagcccatcctggagctggcccccgtggaccagaccacctacatcaaggagaaggacgtgagatgcaagacctggatgtgcagagtgagagacgagggcctgcaggtgatcttcgagcccttcaagaacctgttcggcagctacatcggcatcttctacaccttcctgatcaccctgatcgccgtgttcgtggtgatctacatcgtgctgcccatctgcttcaagctgagagacaccctgagacagcacgaggacgcctacaagagagagatgaagatcagatga

SEQ ID NO: 9353 - RNA, 4323 nt, synthetic construct
  misc_feature 1..4323: note = derived and/or modified CDS sequence (opt4) from TAHV(XJ0708)__HM243138.1__GP
  source 1..4323: mol_type = other RNA
atgatcctggtgctggtgttcgtggccctgagcgccgccagccccgtgtaccagagatgcttccaggacggcgccatcgtgaagcagagccccagcaagcaggccgtgaccgaggtgtgcctgaaggacgacgtgagcatgatcaagaccgaggccagatacttcaagaacgccaccggcacctacgccaacaacgtggccatcagaaagtggctggtgagcgactggcacgactgcagacccaagaagatcagcggcggccacatcaacgtgatcgaggtgggcgacgacctgaccctgcacaccgaggcctacgtgtgcaacgccgactgcatcatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacatcctgatgcccatcttcatccccctggcctacgtgtacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatgatcgccggcgagacccaggagaccttcaagctggaggacctgcccgacgacatgctgagcatggccatgaagctgaacatgtactacctgatgtgcatcgtgaactacatcgtgacctggagcttcatcatctgcgccctgatcatcgccctgatcttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctggtgaacttcctgatcgtgtacatcctgctgatgctggtgaaggacagcatcctgatcgtgcaggccgagggcaccgacttcgacaagtgcagcggcgaggccggcatcatctggaactgcaccggccccttcctgaacctgggcaactgcgagaagaagcagaagaaggagagctacaacaacatcgccacccagctgaagggcctgaacgccatcagcgtgctggacatccccatgatcagcagaatccccgaggacatcgccggcgccctgagattcatcgaggaccagaacagctaccacgtgcagctgaccgccgagtacgccatgctgaccagatactgcgactactacacccagttcagcgacaacagcggctacagccagaccacctggagagtgtacctgagaagccacaacttcgaggcctgcatcctgtacagcaaccagcacttctgcagatgcgtgaagcacggcgacaagtgcagcagcagcaactgggacttcgccaacgagatgaagaactactacagcggcaagcagagcaagttcaacaaggacctgaacctggccctgatgagcctgcaccacgccttcagaggcaccagcagcttctacatcgccaagctgctgagagagaagaagaacgaggagctgatcaactacgtggaggagatcaagaagaagtaccccggcaacgccctgctgaaggccgtgatcgactacatcaagtacatgaagaacctgaccgagatggccagcttcaagcacgacgagatgtgggacgagttcgtgtacgagagcccccccaccagaagccccagcgccagaagaagcgagagcgagtacgacttcaagaccaacgtgaacagcaagcccacccacgtgtgcaagaacatcaagaccgtggtgtgcctgagccccaagagcggcgtgagctacgacagcatcatcgcctgcggcgagcccggccagcccagcgtgtacagaaagcccgagcagcaggtgttccagagcaacgccgaccagacccacttctgcctgctggacacccactgcctggagaactacaccaccgtgaacgacgagatcctggacgccatcaagaagagcagatgctgggagaccgagttcaccgagtacatccagttcaagcagggcgacggcgtgagaagctgcagaatgaaggacagcggcgagtgcgccgtggccgccaacagatggcccatcatcctgtgcgacaacaacaagttctactacagcgagctgcagaaggactacgacaaggaccaggacatcggccacttctgcctgagccccagatgcaacaccatcagacaccccatcaaccagaagcacatcagcaactgcacctggcaggtgagccacaacaacatcgagaagatcgaggtgcacgagctggagaacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcagcgtgtacaccagactgtacaccaccggccccaccatcggcatcaacaccagacacgacgagctgtgcaccggcccctgccccgtgaacgtgccccacaacaccggctggctgaccttcgccaaggagagaaccagcagctggggctgcgaggagttcggctgcctggccatcagcgacggctgcgtgttcggcagctgccaggacatcatcaaggaggagctgaccgtgtacagaaaggagaccgaggagaccaccgacgtggagctgtgcctgaccttcgccgacaagacctactgcaccaacctgaacgccatcacccccatcatcaccgaccagttcgaggtgcagttcaagaccgtggaggcctacagcctgcccagaatcatcgccgtgagaaaccacgagatcctggtgggccagatcaacgacctgggcgtgtacagcaagggctgcggcaacgtgcagaaggtgaacaagaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcaccgtgaccgtgatcgactacaagaagatcctgggcaccatcaagatgaaggccatcctgggcgacgtgaagtacaagaccttcgccgacaacgtggacctgaccatcgagggcgtgtgcaccggctgcatcaactgcttcgagaacatccactgcgagctgaccatccacagcaccgtggaggccagctgccccatcatcagcagctgcaccgtgttccacgacagaatcctgatcacccccaacgagcacaagtacgccatcaaggtgatctgcaacgagaagcccggcagcagcctgagcttcagagtgtgcaacaccaagaccgacgccgccatgaccctgaccgacgccaagcccatcctggagctggcccccgtggaccagaccgcctacatcaaggagaaggacgagagatgcaagacctggatgtgcagagtgagagacgagggcctgcaggtgatcttcgagcccttcaagaacctgttcggcagctacatcggcatcttctacaccttcatcctgagcctgatcgccatcttcatcatcatctacatcgtgctgcccatctgcttcaagctgagagacaccctgagacagcacgaggacgcctacaagagagagatgaagatcagatga

SEQ ID NO: 9354 - RNA, 4323 nt, synthetic construct
  misc_feature 1..4323: note = derived and/or modified CDS sequence (opt4) from TAHV(XJ0710)__HM243141.1__GP
  source 1..4323: mol_type = other RNA
atgatgttcgtgctgttcttcatcgccctgagcgccgccagccccgtgtaccagagatgcttccaggacggcgccatcgtgaagcagaaccccagcaagcaggccgtgaccgaggtgtgcctgaaggacgacgtgagcatgatcaagaccgaggccagatacttcaagaacgccaccggcacctacgccaacaacgtggccatcagaaagtggctggtgagcgactggcacgactgcagacccaagaaggtggccggcggccacatcaacgtgatcgaggtgggcgacgacctgaccctgcacaccgaggcctacgtgtgcaacgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccagcagcatctgccagaacgtggagatcatcatcctgaccgtgctgaccctgctgatcttcatcctgctgagcatcctgagcaagacctacatctgctacctgctgatgcccatcttcatccccctggcctacgtgtacggcgtgatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatcaccgccgtgctgatcctgaccttcgtgacccccatcaacgccatggtggccggcgacacccaggagaccttcaagctggaggacctgcccgacgacatgctgagcatggccatgaagatccagatgtactacatcatgtgcatcgtgaactacatcgtgacctggagcttcatcgtgtgcgccctgatcatcgccctgatcttcaagaagtaccagcacagattcctgaacttctacgccatgtactgccacgagtgcgacatgtaccacgacagaagcggcctgaagtacaacggcgacttcaccaacaagtgcagacagtgcacctgcggccagtacgaggacgccgccggcctgctgacccacagaaagacctacaactgcctggtgcagtacaagagcaagtggctggtgaacttcctgatcatctacatcctgctgatgctggtgaaggacagcgtgctgatcgtgcaggccgagggcatcgacttcgagaagtgcagcggcgagatcaacatcacctggaactgcaccggccccttcctgaacctgggcaactgcgagaagaagcagaagaaggagccctacagcaacatcgccacccagctgaagggcctggacgccatcagcatcctggacatccccatgatcagcagaatccccgaggacatcgccggcgccctgagattcatcgaggagcagaacagctaccacgtgcagctgaccgccgagtacgccatgctgaccagatactgcgactactacacccagttcagcgacaacagcggctacagccagaccacctggagagtgtacctgagaagccacgacttcgaggcctgcatcctgtaccccaaccagcacttctgcagatgcgtgaagcacggcgacaagtgcagcagcagcaactgggacttcgccagcaagatgaagaactactacaccggcaagcagctgaagttcaacaaggacctgaacctggccctgatgagcttccaccacgccttcagaggcaccagcagcttctacgtggccaagctgctgagagagaagaacaacgacgagctggtgaactacaccgagaagatcaagaacaagtaccccggcaacgccctgctgaaggccatcatcgactacatcaagtacatgaagagcctgagcgagatgaccaacttcaagcacgacgagatgtgggacgacttcgtgttcaacagcccccccaccaagagccccagcgtgagaagaagcgacagcgcctacgacttcaagaacaacatcaacagcaaccccagccacatctgcaagaacatcaagaccgtggtgtgcctgagccccaagagcggcgtgagctacgacagcatcatcgcctgcggcgagcccagccagcccaccatctacaagaagcccgagagcagagtgttccagagcaacgccgaccagacccacttctgcctggccgacacccactgcctggagaactacgagaccgtgggcgaggagatcctggacgccatcaagaagagcaagtgctgggagaccgacttcaccgagtacatccagttcaagcagagcgacggcgtgagaagctgcagaatgaaggacagcggcgagtgcaccgtgaccaccaacagatggcccatcatcctgtgcgacaacaacaagttctactacagcgagctgcagaaggactacgacaaggaccaggacatcggccacttctgcctgagccccagatgcaacaccatcagacaccccatcaaccagaagcacatcagcaactgcacctggcaggtgagccacaacaacatcgagaagatcgaggtgcacgagctggagaacctggagcagtacaagaaggccatcacccagaagctgcagaccagcctgaccctgttcaagtacagcaagaccaagaacctgccccacatcaagcccatgtacaagtacatcaccatcgagggcaccgagaccgccgagggcatcgagagcgcctacatcgagagcgagatccccgccctggccggcaccagcatcggcttcaagatcaccagcaagagcggcaagcacctgctggacgtgatcggctacgtgaagagcgccagctacagcgccgtgtacaccaagctgtacaccaccggccccaccatcggcgtgaacaccaagcacgacgagctgtgcaccggcccctgccccgtgaacgtgccccacggcaccggctggctgaccttcgccaaggagagaaccagcagctggggctgcgaggagttcggctgcctggccatcagcgacggctgcgtgttcggcagctgccaggacatcatcaaggaggagctggccgtgtacagaaaggagaccgaggaggccaccgacgtggagctgtgcctgaccttcgccgacaagacctactgcaccaacctgaacgccatcacccccatcatcaccgaccagttcgaggtgcagttcaagaccgtggagagctacagcctgcccagaatcatcgccgtgagaaaccacgagatcatggtgggccagatcaacgacatcggcgtgtacagcaagggctgcggcaacgtgcagaaggtgaacaacaccaactacggcaacggcgtgcccaagttcgactacctgtgccacctggccagcagaaaggaggtgatcgtgagaaagtgcttcgacaacgactaccaggcctgcaagttcctgcagacccccgccagctacagactggaggaggagggcggcagcgtgaccgtgatcgactacaagaagatcctgggcaccatcaagatgaaggccatcctgggcgacgtgaagtacaagaccttcgccgacaacgtggacctgaccgtggagggcgtgtgcaccggctgcatcaactgcttcgagaacatccactgcgagctgaccatccacagcaccgtggaggccagctgccccgtgaccagcagctgcaccgtgttccacgacagaatcctgatcacccccaacgagcacaagtacgccatcaaggtgatctgcgccgagaagcccggccccagcctgcagttcaagatctgcaacgccaagaccgacgccgccatgaccctggccgacgccaagcccatcctggagctggcccccgtggaccagaccacctacatcaaggagaaggacgagagatgcaagacctggatgtgcagagtgagagacgagggcctgcaggtgatcttcgagcccttcaagaacctgttcggcagctacatcggcatcttctacaccttcctgatcaccctgatcgccgtgttcatcgtgatctacatcgtgctgcccatctgcttcaagctgagagacaccctgagacagcacgaggacgcctacaagagagagatgaagatcagatga

SEQ ID NO: 9355 - RNA, 4326 nt, synthetic construct
  misc_feature 1..4326: note = derived and/or modified CDS sequence (opt4) from TVTV__AF123491.1__GP
  source 1..4326: mol_type = other RNA
atgatcgtgttcgccctgctgaccatcgtggccgccagccccgtgtacaagagatgcttccaggacggcgccatcgtgagacaggagtacagcaagaacgccgtgaccgaggtgtgcctgaaggacgacgtgagcatgatcaagaccgaggccgagtacttcaagaacagcaccggcgtgttcagcaagaacatcgcctacagaaagtggctggtgagcgactggaacgagtgcagaccccagaagagcgccaacggccacatcaacgtgatcgaggtgcagcccgacctgagcctgcagaccaacagctacgtgtgcgccgccacctgcgtgatcagcatcgacaaggagaccgcccaggtgagactgcagaccgacaccaccaaccacttcgagatcagcggcaccaccgtgaagagcggctggttcaagagcaccacctacctgaccctggaccagacctgcgagcacctgaagatcagctgcggcagcaagagcgtgcagctgcacgcctgcttcaaccagcacatgagctgcgtgagattcctgcacagaaccatcctgcccggcaagcacagaaagagcatctgccagaacatcgagatcatcatcctgaccagcctgagcctgttcatcttcctgttcctgaccatcatcagcaagacctacatctgctacgtgctgatccccatcttcatccccatcgcctacgtgtacggcttcatctacaacaagagctgcaagaagtgcaagctgtgcggcctggtgtaccaccccttcaccgagtgcggcagccactgcgtgtgcggcgccaagtacgacaccagcgacagaatgaagatgcacagaagcagcggcctgtgccccggctacaagagcctgagagccgccagaagcatgtgcaagagcaagggccccgcccccatcctgagcctgctgagcgccgtgctgatcctgaccttcgtgacccccatcaccgccatcagcctgaaggacgaggagaaggagacctacaagctgcccgagctgcccgacgacaaggtgaacctggagaccaagatcgacctgtacttccagatgtgcctgatcaactacgccaccacctgggccctgatcttctgcgtgctgatcaccgcctgcctgttcaagaagctgcagcacaagttcctggactactacgccgtgtactgccacgagtgcgacatgtaccacgagaagaccagcctgaagtacaacggcgacttcagcaacaagtgcagacagtgcacctgcgagcagtacgaggacgccaccggcctgctgacccacagaaagagctacaacagactggtgcagtacaaggccaagtggaccctgaacttcctgatcacctacgccatcctggtgatcatcaaggacagcgtgatgatcgtgggcgccagcaacaccgacgtgaaggactgcctggaccaggaggagatcacctggaactgcaccggccccttcctgaacatgggcagatgcaccagaccccagaagaaggagaactacggcaacatcgccacccagctgaagggcctggacgtgctgagcgccctggacatgcccgccgtgggcaagatccccgaggacatcgccggcgccctgagctacatcgagagcaagaagacctaccacgagcagctgaccctggagttcgccatgctgaccagatactgcgacttctacaagcagtacgccgacaacagcggctacagccagaccacctggagagcctacatcagaagccacgacttcggcgtgtgcatcatgtaccccaaccagcacttctgcagatgcgtgaagatgggcgagaagtgcaccagcagcaactgggacttcgccaaccagatggccaactactacaacggcaagcagaacagattcaacaaggacctgaacctggccctgtacaccatgcaccacgccttcagaggcagcaccagctacctgatcagcaaggtgctgcacgagaagaagtacgaccagctgaccaacctgctgacccagctgaagaccaagtaccccggcaacgccctgctgaaggccctgatcggctaccagatctacctgaagagcctgagcgagatgagcagcttcacccccgacgagctgtgggacgacctgcagtacgtgcccgcccccaccttcaagcccaacctgggcagaagcggcgacaacgagtacaagttcgacaagagcagaatcgtggacccccagaccacctgcaccagcctgaagggcgtgaactgcctgagccccagaagcagagccagcgtgagcgacatcatcgcctgcggccaggccacccagcccgccctgttctacgtgcccaacgacaagatccaccagagcaacaccgaccagaaccagtactgcatcggcgacagccactgcctgaccaagttcacccccatcaccgaggagctgctggccgccgtgaagaagagcaagtgccaggccttcgacctggacaacatcgtgaagaccagcaccagcaccggcgtgagaagctgcctggtgaagaagttcggcaactgcaacaccaccaaccaggtgtggcccatcaccatctgcagcgacgaccagtactactacaccgacaccaagcagagctacgacagctaccaggacatcggccacttctgcctgagccccagatgcagcaccatcagataccccgtgaaccccaagcacctgagcgcctgcacctggaccgaggagtacacccccgtggacaagatcagcgtgaccaacatcgaggagatcgagcagtacaagaaggccctgctgcagaagctgcagaccggcctgaacatcttcaagtacagaaagaccagcaacctgccccacatcaagagcatgtacaagtacatcaccgtgcagggcaccggcaccgccgagggcgtggagaacgcctacatcgagagcgagatgcccgccctggccggcagcagcagcggcttcaaggtgctgagcaaggagggcaaccacctgttcgacgtggtggcctacatcaagagcgccagctacagcagcgtgtacaacaagctgtacagcaccggccccaccctgggcatcaacgtgaagcacgacgagaagtgcaccggcccctgccccgccaacatcccccacaagaccggctggctgaccttcgccagagagagaaccagcacctggggcagagaggagtacggctgcctggccatcagcgacggctgcgtgttcggcagctgccaggacatcatcaagcccgagatgaccgtgtacagaaagcagaccgacgagatcgtgaccgtggagctgtgcctgaccttcgtggacaagacctactgcaccgagctgaacgccgtgacccccatcatcagcgacctgttcgaggtgcagttcaagaccgtggagagctacagcctgcccaagatcgtggccatcaagaaccaccagatcttcgtgggccagatcaacgtgatcggcaccaacagcaagggctgcggcaacgtgcaggtgttcaacggcaccaactacggcagcggcacccccagattcgactacctgtgccacctggccagcagaagagaggtgatcatgagaaagtgcttcgacaacgactaccaggcctgcaagttcctgcagcagcccagcagcttcagactggaggaggagggcgagaccgtgaccatcatcgactacaagaagatcctgggcaccatcaagatgaaggccatcttcggcgacgtgaagtacagaaccttcagcgagaaggtggacatcaacgccgagggcgtgtgcgccggctgcatcaactgcttcgagagaatcaactgcgagttcaccatccacagcaccgtggagaccagctgccccctggtggccgactgccagctgttccacgacagactgctgatcacccccaacgagcacaagtacgccatcaaggccatctgcaaggacaagcccagcaacaccctgagattcagcatctgcaacaccaaggtggaggccaccgtgaccatcatcgacgccaagcccatcctggagctggcccccgtggaccagaccgcctacatcaaggagaaggacgagagatgcaagacctggctgtgcagagtgaaggacgagggcgtggccgtgctgctggagcccttcaagaacctgttcggcagctacatcggcatcttctacggcatcatcctggtggtgctggccatcctggtgtgcatctacatcgtgctgcccgtgtgcttcaagatcaaggacaccctgaagaagcacgaggacgcctacaagagagagatgaagatcagatga

SEQ ID NO: 9356 - RNA, 4335 nt, synthetic construct
  misc_feature 1..4335: note = derived and/or modified CDS sequence (opt4) from TVTV(AR42)__KX891322.1__GP
  source 1..4335: mol_type = other RNA
atgagaaacatgatcgtgttcgccctgctgaccatcgtggccgccagccccgtgtacaagagatgcttccaggacggcgccatcgtgagacaggagtacagcaagaacgccgtgaccgaggtgtgcctgaaggacgacgtgagcatgatcaagaccgaggccgagtacttcaagaacagcaccggcgtgttcagcaagaacatcgcctacagaaagtggctggtgagcgactggaacgagtgcagaccccagaagagcgccaacggccacatcaacgtgatcgaggtgcagcccgacctgagcctgcagaccaacagctacgtgtgcgccgccacctgcgtgatcagcatcgacaaggagaccgcccaggtgagactgcagaccgacaccaccaaccacttcgagatcagcggcaccaccgtgaagagcggctggttcaagagcaccacctacctgaccctggaccagacctgcgagcacctgaagatcagctgcggcagcaagagcgtgcagctgcacgcctgcttcaaccagcacatgagctgcgtgagattcctgcacagaaccatcctgcccggcaacatcgccaacagcatctgccagaacatcgagatcatcatcctgaccagcctgagcctgttcatcttcctgttcctgaccatcatcagcaagacctacatctgctacgtgctgatccccatcttcatccccatcgcctacgtgtacggcttcatctacaacaagagctgcaagaagtgcaagctgtgcggcctggtgtaccaccccttcaccgagtgcggcagccactgcgtgtgcggcgccaagtacgacaccagcgacagaatgaagatgcacagaagcagcggcctgtgccccggctacaagagcctgagagccgccagaagcatgtgcaagagcaagggccccgccagcatcctgagcctgctgagcgccgtgctgatcctgaccttcgtgacccccatcaccgccatcagcctgaaggacgaggagaaggagacctacaagctgagcgagctgcccgacgacatggtgaacctggagaacaagatcgacctgtacttccagatgtgcctgatcaactacgccaccacctgggccctgatcttctgcgccctgatcaccgcctgcctgttcaagaagctgcagcacaagttcctggactactacgccgtgtactgccacgagtgcgacatgtaccacgagagaagaggcctgaagtacaacggcgacttcagcaacaagtgcagacagtgcacctgcggccagtacgaggacgccaccggcctgctgacccacagaaagagctacaactgcctggtgcagtacaaggccaagtggatgctgaacttcctgatcacctacgccatcctggtgatcatcaaggacagcgtgatgatcgtgggcgccagcgacaccgacgtgaaggactgcctggaccaggaggagatcacctggaactgcaccggccccttcctgaacatgggcagctgcaccagaccccagaagaaggagaactacggcaacatcgccacccagctgaagggcctggacgtgctgagcgccctggacatgcccgccgtgggcaagatccccgaggacatcgccggcgccctgagctacatcgagagcaagaagacctaccacgagcagctgaccctggagttcgccatgctgaccagatactgcgacttctacaagcagtacgccgacaacagcggctacagccagaccacctggagagcctacatcagaagccacgacttcggcgtgtgcatcatgtaccccaaccagcacttctgcagatgcgtgaagatgggcgagaagtgcaccagcagcaactgggacttcgccaaccagatggccaactactacaacggcaagcagaacagattcaacaaggacctgaacctggccctgtacaccatgcaccacgccttcagaggcagcaccagctacctgatcagcaaggtgctgcacgagaagaagtacgaccagctgaccaacctgctgacccagctgaagaccaagtaccccggcaacgccctgctgaaggccctgatcgactaccagatctacctgaagagcctgagcgagatgagcagcttcacccccgacgagctgtgggacgacctgcagtacgtgcccgcccccaccttcaagcccaacctgggcagaagcgaggacaacgagtacaagttcgacaagagcagaatcgtggacccccagaccacctgcaccagcctgaagggcgtgaactgcctgagccccagaagcagagccagcgtgagcgacatcatcgcctgcggccaggccacccagcccgccctgttctacgtgcccaacgacaagatccaccagagcaacaccgaccagaaccagtactgcatcggcgacagccactgcctgaccaagttcacccccatcaccgaggagctgctggccgccgtgaagaagagcaagtgccaggccttcgacctggacgacatcgtgaagaccagccccagcaccggcgtgagaagctgcctggtgaagaagttcggcaactgcaacaccaccaaccaggtgtggcccatcaccatctgcagcgacgaccagtactactacaccgacaccaagcagagctacgacagcaaccaggacatcggccacttctgcctgagccccagatgcagcaccatcagataccccgtgaaccccaagcacctgagcgcctgcacctggaccgaggagtacacccccgtggacaagatcagcgtgaccaacatcgaggagatcgagcagtacaagaaggccctgctgcagaagctgcagaccggcctgaacatcttcaagtacaagaagaccagcaacctgccccacatcaagcccatgtacaagtacatcaccgtgcagggcaccgagaccgccgagggcgtggagaacgcctacatcgagagcgagatgcccgccctggccggcagcagcagcggcttcaaggtgctgagcaaggagggcaaccacctgttcgacgtggtggcctacatcaagagcgccagctacagcagcgtgtacaacaagctgtacagcaccggccccaccctgggcatcaacgtgaagcacgacgagaagtgcaccggcccctgccccgccaacatcccccacaagaccggctggctgaccttcgccagagagagaaccagcacctggggctgcgaggagtacggctgcctggccatcagcgacggctgcgtgttcggcagctgccaggacatcatcaagcccgagatgaccgtgtacagaaagcagaccgacgagatcgtgaccgtggagctgtgcctgaccttcgtggacaagacctactgcaccgagctgaacgccgtgacccccatcatcagcgacctgttcgaggtgcagttcaagaccgtggagagctacagcctgcccaagatcgtggccatcaagaaccaccagatcttcgtgggccagatcaacgacatcggcacctacagcaagggctgcggcaacgtgcaggtgttcaacggcaccaactacggcagcggcacccccagattcgactacctgtgccacctggccagcagaaaggaggtgatcatgagaaagtgcttcgacaacgactaccaggcctgcaagttcctgcagcagcccagcagcttcagactggaggaggagggcgagaccgtgaccatcatcgactacaagaagatcctgggcaccatcaagatgaaggccatcttcggcgacgtgaagtacaagaccttcagcgagaaggtggacatcaacgccgagggcgtgtgcgccggctgcatcaactgcttcgagagcatcaactgcgagttcaccatccacagcaccgtggagaccagctgccccctggtggccgactgccagctgttccacgacagactgctgatcacccccaacgagcacaagtacgccatcaaggccatctgcaaggacaagcccagcaacaccctgagattcagcatctgcaacaccaaggtggaggccaccgtgaccatcatcgacgccaagcccatcctggagctggcccccgtggaccagaccgcctacatcaaggagaaggacgagagatgcaagacctggctgtgcagagtgaaggacgagggcgtggccgtgctgctggagcccttcaagaacctgttcggcagctacatcggcatcttctacggcatcatcctggtggtgctggccatcctggtgtgcatctacatcgtgctgcccgtgtgcttcaagatcagagacaccctgaagaagcacgaggacgcctacaagagagagatgaagatcagatga

SEQ ID NO: 9357 - RNA, 4335 nt, synthetic construct
  misc_feature 1..4335: note = derived and/or modified CDS sequence (opt4) from TVTV(Eklund)__KR149248.1__GP
  source 1..4335: mol_type = other RNA
atgagaaacatgatcgtgttcgccctgctgaccatcgtggccgccagccccgtgtacaagagatgcttccaggacggcgccatcgtgagacaggagtacagcaagaacgccgtgaccgaggtgtgcctgaaggacgacgtgagcatgatcaagaccgaggccgagtacttcaagaacagcaccggcgtgttcagcaagaacatcgcctacagaaagtggctggtgagcgactggaacgagtgcagaccccagaagagcgccaacggccacatcaacgtgatcgaggtgcagcccgacctgagcctgcagaccaacagctacgtgtgcgccgccacctgcgtgatcagcatcgacaaggagaccgcccaggtgagactgcagaccgacaccaccaaccacttcgagatcagcggcaccaccgtgaagagcggctggttcaagagcaccacctacctgaccctggaccagacctgcgagcacctgaagatcagctgcggcagcaagagcgtgcagctgcacgcctgcttcaaccagcacatgagctgcgtgagattcctgcacagaaccatcctgcccggcaacatcgccaacagcatctgccagaacatcgagatcatcatcctgaccagcctgagcctgttcatcttcctgttcctgaccatcatcagcaagacctacatctgctacgtgctgatccccatcttcatccccatcgcctacgtgtacggcttcatctacaacaagagctgcaagaagtgcaagctgtgcggcctggtgtaccaccccttcaccgagtgcggcagccactgcgtgtgcggcgccaagtacgacaccagcgacagaatgaagatgcacagaagcagcggcctgtgccccggctacaagagcctgagagccgccagaagcatgtgcaagagcaagggccccgccagcatcctgagcctgctgagcgccgtgctgatcctgaccttcgtgacccccatcaccgccatcagcctgaaggacgaggagaaggagacctacaagctgagcgagctgcccgacgacatggtgaacctggagaccaagatcgacctgtacttccagatgtgcctgatcaactacgccaccacctgggccctgatcttctgcgccctgatcaccgcctgcctgttcaagaagctgcagcacaagttcctggactactacgccgtgtactgccacgagtgcgacatgtaccacgagagaagaggcctgaagtacaacggcgacttcagcaacaagtgcagacagtgcacctgcggccagtacgaggacgccaccggcctgctgacccacagaaagagctacaactgcctggtgcagtacaaggccaagtggatgctgaacttcctgatcacctacgccatcctggtgatcatcaaggacagcgtgatgatcgtgggcgccagcaacaccgacgtgaaggactgcctggaccaggaggagatcacctggaactgcaccggccccttcctgaacatgggcagatgcaccagaccccagaagaaggagaactacggcaacatcgccacccagctgaagggcctggacgtgctgagcgccctggacatgcccgccgtgggcaagatccccgaggacatcgccggcgccctgagctacatcgagagcaagaagacctaccacgagcagctgaccctggagttcgccatgctgaccagatactgcgacttctacaagcagtacgccgacaacagcggctacagccagaccacctggagagcctacatcagaagccacgacttcggcgtgtgcatcatgtaccccaaccagcacttctgcagatgcgtgaagatgggcgagaagtgcaccagcagcaactgggacttcgccaaccagatggccaactactacaacggcaagcagaacagattcaacaaggacctgaacctggccctgtacaccatgcaccacgccttcagaggcagcaccagctacctgatcagcaaggtgctgcacgagaagaagtacgaccagctgaccaacctgctgacccagctgaagaccaagtaccccggcaacgccctgctgaaggccctgatcgactaccagatctacctgaagagcctgagcgagatgagcagcttcacccccgacgagctgtgggacgacctgcagtacgtgcccgcccccaccttcaagcccaacctgggcagaagcgaggacaacgagtacaagttcgacaagagcagaatcgtggacccccagaccacctgcaccagcctgaagggcgtgaactgcctgagccccagaagcagagccagcgtgagcgacatcatcgcctgcggccaggccacccagcccgccctgttctacgtgcccaacgacaagatccaccagagcaacaccgaccagaaccagtactgcatcggcgacagccactgcctgaccaagttcacccccatcaccgaggagctgctggccgccgtgaagaagagcaagtgccaggccttcgacctggacaacatcgtgaagaccagccccagcaccggcgtgagaagctgcctggtgaagaagttcggcaactgcaacaccaccaaccaggtgtggcccatcaccatctgcagcgacgaccagtactactacaccgacaccaagcagagctacgacagctaccaggacatcggccacttctgcctgagccccagatgcagcaccatcagataccccgtgaaccccaagcacctgagcgcctgcacctggaccgaggagtacacccccgtggacaagatcagcgtgaccaacatcgaggagatcgagcagtacaagaaggccctgctgcagaagctgcagaccggcctgaacatcttcaagtacagaaagaccagcaacctgccccacatcaagcccatgtacaagtacatcaccgtgcagggcaccgagaccgccgagggcgtggagaacgcctacatcgagagcgagatgcccgccctggccggcagcagcagcggcttcaaggtgctgagcaaggagggcaaccacctgttcgacgtggtggcctacatcaagagcgccagctacagcagcgtgtacaacaagctgtacagcaccggccccaccctgggcatcaacgtgaagcacgacgagaagtgcaccggcccctgccccgccaacatcccccacaagaccggctggctgaccttcgccagagagagaaccagcacctggggctgcgaggagtacggctgcctggccatcagcgacggctgcgtgttcggcagctgccaggacatcatcaagcccgagatgaccgtgtacagaaagcagaccgacgagatcgtgaccgtggagctgtgcctgaccttcgtggacaagacctactgcaccgagctgaacgccgtgacccccatcatcagcgacctgttcgaggtgcagttcaagaccgtggagagctacagcctgcccaagatcgtggccatcaagaaccaccagatcttcgtgggccagatcaacgacatcggcacctacagcaagggctgcggcaacgtgcaggtgttcaacggcaccaactacggcagcggcacccccagattcgactacctgtgccacctggccagcagaaaggaggtgatcatgagaaagtgcttcgacaacgactaccaggcctgcaagttcctgcagcagcccagcagcttcagactggaggaggagggcgagaccgtgaccatcatcgactacaagaagatcctgggcaccatcaagatgaaggccatcttcggcgacgtgaagtacaagaccttcagcgagaaggtggacatcaacgccgagggcgtgtgcgccggctgcatcaactgcttcgagagcatcaactgcgagttcaccatccacagcaccgtggagaccagctgccccctggtggccgactgccagctgttccacgacagactgctgatcacccccaacgagcacaagtacgccatcaaggccatctgcaaggacaagcccagcaacaccctgagattcagcatctgcaacaccaaggtggaggccaccgtgaccatcatcgacgccaagcccatcctggagctggcccccgtggaccagaccgcctacatcaaggagaaggacgagagatgcaagacctggctgtgcagagtgaaggacgagggcgtggccgtgctgctggagcccttcaagaacctgttcggcagctacatcggcatcttctacggcatcatcctggtggtgctggccatcctggtgtgcatctacatcgtgctgcccgtgtgcttcaagatcaaggacaccctgaagaagcacgaggacgcctacaagagagagatgaagatcagatga

SEQ ID NO: 9358 - RNA, 4335 nt, synthetic construct
  misc_feature 1..4335: note = derived and/or modified CDS sequence (opt4) from JCV(3324-04)__HM007357.1__GP
  source 1..4335: mol_type = other RNA
atggaggtgctgaacctgatctggctgctgaccctgtgcctggccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgaccatcgtgagcaagacctacatctgctacctgctgatgcccatcttcatccccatcgccttcatctacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcgtgctgagcatcatgaccgccgtgctgatcctgaccttcgtgacccccatcagcgccatggtgatcggcgagagcagcgagatctacaccctggaggacctgcccgacgacatggtgcagatggccgagagaatcaacatctactaccagatcatcatcatcaactacggcatcacctgggccttcctgctgctgggcctgctgctggcctacttcttcagaaagtaccagcacagattcctggacttctacgccatgtactgcgaggagtgcgacatgtaccacgagaaggccggcctgacccactggggcgacttcaccaacaagtgcagacagtgcacctgcggccagtacgaggacatcaccggcctgatggtgcacaagaagagctacaactgcctggtgaagtacaaggccaagtggatcagagacatcctgatcacctacctggtgatcatcctggtgaaggacagcctgctgttcgtgggcgccaccggcaccgacttcgccacctgcatcgacgagaagaccgtgacctggaactgcaccggccccttcctgaacctgggcagatgcgacaagagccagaagaagaccaactacgccgacatcgccaaccagctgaagggcctgggcgtgatcagcgtgctggacatccccatgatcaagaagatgcccgacgagatcagcggcagcctgaagtacatcgacaacctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggccagaaggccaagttcaacaaggacctgaacctggccctgctggtgctgcacaaggccttcagaggcaccggcaccgcctacatcgccgaggccatggccagaaaggacaacggcagcatggcccacttcgccctggaggtgagaaagaagttccccaccaacgccctgctggccgccctgatcgactacatcgtgtacctgcagagcctggccgagatcagcaccttcgagctggacgaggactgggaggacttcaagtacaagcccgagcccaccgagagcaccatccaggccagaagccacagagacgaccagtacaacttcaagaacgccgccagcggcagcaacgtgaaggtgtgcaagaacatccagaaggtgctgtgcatcagccccagaagcagagccaagttcgagaacatcatcgcctgcggcgagcacgccaaccccagcgtgtacatgatgcccaacgtgagcatctaccagagcagcagcgagagaagccactactgcatcgccgacagccactgcctggaggagtacgaggtggtggagaccgagctgctgaacgccctgaagaagagcaagtgctgggtgaaggagatggacgacgtgatcctgcacaagcagagcgacggcctgagaagctgcagaatgaaggacaccggcaactgcaacgtgcaggagaacgactggaacatcgtgctgtgcgagaacggcaactactactacagcgagatccacaaggactacgacaaggaccaggacgtgggccacttctgcctgagccccagatgcaacaccatcagataccccatcagcaagagacacatcagaagctgcaactggcagatcagccacagcaccatcgacaagatcgccgtgcaggagctggccgacatcgagcagtacaagaaggccatcagccagaagctgcagaccagcctgagcatcttcaagtacatcaagaccaagaacctgccccacatcaagcccgcctacaagtacatcaccgtggagggcgtggagaccgtggagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcatcaacaccagacacgacgagaagtgcaccggcccctgccccgccgtgatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggaggcctacaccctgcccagaatcatcgccgtgaagaaccacgagatcaaggtgggccagatcaacgacctgggcgtgtacagcaagggctgcggcaacgtgcagaaggtgaacggcaccaactacggcaacggcgcccccagattcgactacctgtgccacctggccagcagaaaggaggtgatcctgagaaagtgcttcgacaacgactaccaggcctgcaagttcctgcagagccccagcagctacagactggaggagcaccagggcaccgtgaccgtgatcgactacaagaagatcctgggcaccatcaagatgaaggccatcctgggcgacgtgaagtacaagaacttccagagcaacatcgagatcaacgccgagggcacctgcgccggctgcatcaactgcttcgagaacatccactgcgagttcaccatccacaccaccgtggagaccagctgccccatcgtgaccgactgcgtgagcttccacgacagaatcctgatcacccccgacgagcacaagtacgccctgaaggtggtgtgccaggacaagcccaaggtgagcctgaagttcaagatctgcaacaccaacatcgacgccagcatgaccatcgtggacagcaagcccatcctggagctggcccccgtggaccagaccgcctacatcagagagaaggacgagagatgcaagacctggatgtgcagagtgagagacgagggcttccaggtgatcctggagcccttcaagaacctgttcggcagctacatcggcatcttctacaccggcatcctgagcatcatctgcctgctgatcgtgatctacatcatcctgcccatctgcttcaagctgagagacaccctgagacagcacgaggacgcctacaagaaggagatgaagatcagatga

SEQ ID NO: 9359 - RNA, 4335 nt, synthetic construct
  misc_feature 1..4335: note = derived and/or modified CDS sequence (opt4) from JCV(61V2235)__U88058.1__GP
  source 1..4335: mol_type = other RNA
atggaggtgctgaacctgatctggctgctggccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgagcatcgtgagcaagacctacgtgtgctacctgctgatgcccatcttcacccccatcgccttcatctacggctgggtgtacaacaagagctgcaagaagtgcaagctgtgcggcctggtgtaccaccccttcaccgagtgcggcacccactgcgtgtgcggcgccagatacgagaacagcgacagaatgaagctgcacagagccagcggcctgtgccccggctacaagagcctgagagccgccagagtgatgtgcaagagcaagggccccgccagcatcctgagcatcatgaccgccatcctgatcctgaccttcgtgacccccatcagcgccatggtgatcggcgagagcagcgagctgtacaccctggacgacctgcccaacgacatggtgcagatggccgagagagtgaacatctactaccagatcaccatcatcaactacggcgtgacctgggccttcttctgcctgggcctgatcctggcctacttcttcaagaagtaccagcacaagttcctggacttctacgccatgtactgcgaggagtgcgacatgtaccacgagaagagcggcctgacccactggggcgacttcaccaacaagtgcagacagtgcacctgcggccagttcgaggacgtggccggcctgatgatccacaagaagagctacaactgcctggtgaagtacaaggccaagtggatcagagacatcctgatcatctacctggccatgatcctgatcaaggacagcctgctgttcgtgggcgccagcggcaccgacttcgccgcctgcatcgacgagaaggtggtgacctggaactgcaccggccccttcctgaacctgggcagatgcgacaagagccagaagaaggccagctacgccggcatcgccgaccagctgaagggcctgggcgtgatcagcgtgctggacatccccatgatcaagaacatgcccgacgagatcagcggcagcctgaagtacatcgacagcctggagacctaccacgagcagctgaccgccgagtacgccttcctgaccagatactgcgactactacacccagtacaccgacaagagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggccagaaggtgaagttcaacaaggacctgaacctggccctgctggtgctgcacaaggccttcagaggcaccggcaccgcctacgtggccgaggccatggccagagaggacaacggcagcatggcccacttcgccctggagatcagaaagaagttccccaccaacgccctgctggccgccctgatcgactacatcgtgtacctgcagagcctgggcgagatcgccaccttcgagctggacgaggactgggaggacttcaagtacaagcccgagcccaccgagagcaccccccaggtgagaagccacagaaacgaccagtacaacttcaagaacgccgagagcaacagcgacaccaaggtgtgcaagaacgtgcagaaggtgctgtgcatcagccccagaagcaaggccaagttcgagaacatcatcgcctgcggcgagcacgccaaccccagcgtgtacatgatgcccaacgtgagcatctaccagagcaacagcgagagaagccactactgcatcgccggcagccactgcctggagaagtacgaggtggtggagaccgagctgctgaacgccctgaagaagagcaagtgctgggccaaggagatggacgacatcatcctgcacaagcagagcgacggcctgagaagctgcagaatcaaggacaccggcaactgcaacgtgcaggagaacgactggaccatcgtgctgtgcgagaacggcaactactactacagcgaggtgcacaaggactacgacaaggaccaggacgtgggccacttctgcctgagccccagatgcaccaccatcagataccccatcagcaagagacacatcaagaagtgcgagtggcagatcagccacagcaccatcgacaagatcagcgtgcaggagctggccgacatcgagcagtacaagaaggccatcagccagaagctgcagaccagcctgagcatcttcaagtacgtgagaaccaagaacctgccccacatcaagcccgcctacaagtacatcaccgtggagggcgtggagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccgtgtacaccaagctgtacaccaccggccccaccatcggcatcaacaccaagcacgacgagaagtgcaccggcccctgccccgccatcatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagagtgatcgccatcaagaaccacgagatcaaggtgggccagatcaacgacctgggcgtgtacagcaagggctgcggcaacgtgcagaaggtgaacggcaccaactacggcaacggcagccccagattcgactacctgtgccacctggccagcagaaaggaggtgatcctgagaaagtgcttcgacaacgactaccaggcctgcaagttcctgcagagccccagcagctacagactggaggagcaccagggcaccgtgaccgtgatcgactacaagaagatcctgggcaccatcaagatgaaggccatcctgggcgacgtgaagtacaagaactaccagaacaacatcgagatcagcgccgagggcacctgcgccggctgcatcgactgcttcgagaacatccactgcgagttcaccatccacaccaccgtggaggccagctgccccatcaccaccgagtgcgtgagcttccacgacagaatcctgatcacccccgacgagcacaagtacgccctgaagatcgtgtgccacgacaagcccaaggtgagcctgaagttcaagatctgcaacacccacgtggacgccgccatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgagcatcatctgcctgctgatcgtggtgtacatcatcctgcccatctgcttcaagctgagagacaccctgagacagcacgaggacgcctacaagaaggagatgaagatcagatga

SEQ ID NO: 9360 - RNA, 4335 nt, synthetic construct
  misc_feature 1..4335: note = derived and/or modified CDS sequence (opt4) from JCV(61V2235)__HM007351.1__GP
  source 1..4335: mol_type = other RNA
atggaggtgctgaacctgatctggctgctggccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgagcatcgtgagcaagacctacgtgtgctacctgctgatgcccatcttcatccccatcgccttcatctacggctgggtgtacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatgaccgccatcctgatcctgaccttcgtgacccccatcagcgccatggtgatcggcgagagcagcgaggtgtacaccctggacgacctgcccaacgacatggtgcagatggccgagagagtgaacatctactaccagatcatcatcatcaactacggcgtgacctgggccttcctgctgctgggcctgatcctggcctacttcttcaagaagtaccagcacaagttcctggacttctacgccatgtactgcgaggagtgcgacatgtaccacgagaagagcggcctgacccactggggcgacttcaccaacaagtgcagacagtgcacctgcggccagttcgaggacgtggccggcctgatgatccacaagaagagctacaactgcctggtgaagtacaaggccaagtggatcagagacatcctgatcatctacctggccatgatcctgatcaaggacagcctgctgttcgtgggcgccagcggcaccgacttcgccgcctgcatcgacgagaaggtggtgacctggaactgcaccggccccttcctgaacctgggcagatgcgacaagagccagaagaaggccagctacgccggcatcgccgaccagctgaagggcctgggcgtgatcagcgtgctggacatccccatgatcaagaacatgcccgacgagatcagcggcagcctgaagtacatcgacagcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggccagaaggtgaagttcaacaaggacctgaacctggccctgctggtgctgcacaaggccttcagaggcaccggcaccgcctacgtggccgaggccatggccagaaaggacaacggcagcatggcccacttcgccctggagatcagaaagaagttccccaccaacgccctgctggccgccctgatcgactacatcgtgtacctgcagagcctgggcgagatcgccaccttcgagctggacgaggactgggaggacttcaagtacaagcccgagcccaccgagagcaccccccaggtgagaagccacagaaacgaccagtacaacttcaagaacgccgagagcaacagcgacaccaaggtgtgcaagaacgtgcagaaggtgctgtgcatcagccccagaagcaaggccaagttcgagaacatcatcgcctgcggcgagcacgccaaccccagcgtgtacatgatgcccaacgtgagcatctaccagagcaacagcgagagaagccactactgcatcgccgacagccactgcctggagaagtacgaggtggtggagaccgagctgctgaacgccctgaagaagagcaagtgctgggccaaggagatggacgacatcatcctgcacaagcagagcgacggcctgagaagctgcagaatcaaggacaccggcaactgcaacgtgcaggagaacgactggaccatcgtgctgtgcgagaacggcaactactactacagcgaggtgcacaaggactacgacaaggaccaggacgtgggccacttctgcctgagccccagatgcaccaccatcagataccccatcagcaagagacacatcaagaagtgcgagtggcagatcagccacagcaccatcgacaagatcagcgtgcaggagctggccgacatcgagcagtacaagaaggccatcagccagaagctgcagaccagcctgagcatcttcaagtacgtgagaaccaagaacctgccccacatcaagcccgcctacaagtacatcaccgtggagggcgtggagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccgtgtacaccaagctgtacaccaccggccccaccatcggcatcaacaccaagcacgacgagaagtgcaccggcccctgccccgccatcatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagagtgatcgccatcaagaaccacgagatcaaggtgggccagatcaacgacctgggcgtgtacagcaagggctgcggcaacgtgcagaaggtgaacggcaccaactacggcaacggcagccccagattcgactacctgtgccacctggccagcagaaaggaggtgatcctgagaaagtgcttcgacaacgactaccaggcctgcaagttcctgcagagccccagcagctacagactggaggagcaccagggcaccgtgaccgtgatcgactacaagaagatcctgggcaccatcaagatgaaggccatcctgggcgacgtgaagtacaagaactaccagaacaacatcgagatcaacgccgagggcacctgcgccggctgcatcgactgcttcgagaacatccactgcgagttcaccatccacaccaccgtggaggccagctgccccatcaccaccgagtgcgtgagcttccacgacagaatcctgatcacccccgacgagcacaagtacgccctgaagatcgtgtgccacgacaagcccaaggtgagcctgaagttcaagatctgcaacaccaacgtggacgccgccatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgagcatcatctgcctgctgatcgtggtgtacatcatcctgcccatctgcttcaagctgagagacaccctgagacagcacgaggacgcctacaagaaggagatgaagatcagatga

SEQ ID NO: 9361 - RNA, 4335 nt, synthetic construct
  misc_feature 1..4335: note = derived and/or modified CDS sequence (opt4) from JCV(61V2235)__KX817316.1__GP
  source 1..4335: mol_type = other RNA
atggaggtgctgaacctgatctggctgctggccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgagcctggtgatcttcatcttcctgagcatcgtgagcaagacctacgtgtgctacctgctgatgcccatcttcatccccatcgccttcatctacggctgggtgtacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatgaccgccatcctgatcctgaccttcgtgacccccatcagcgccatggtgatcggcgagagcagcgaggtgtacaccctggacgacctgcccaacgacatggtgcagatggccgagagagtgaacatctactaccagatcatcatcatcaactacggcgtgacctgggccttcctgctgctgggcctgatcctggcctacttcttcaagaagtaccagcacaagttcctggacttctacgccatgtactgcgaggagtgcgacatgtaccacgagaagagcggcctgacccactggggcgacttcaccaacaagtgcagacagtgcacctgcggccagttcgaggacgtggccggcctgatgatccacaagaagagctacaactgcctggtgaagtacaaggccaagtggatcagagacatcctgatcatctacctggccatgatcctgatcaaggacagcctgctgttcgtgggcgccagcggcaccgacttcgccgcctgcatcgacgagaaggtggtgacctggaactgcaccggccccttcctgaacctgggcagatgcgacaagagccacaagaaggccagctacgccggcatcgccgaccagctgaagggcctgggcgtgatcagcgtgctggacatccccatgatcaagaacatgcccgacgagatcagcggcagcctgaagtacatcgacagcctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggccagaaggtgaagttcaacaaggacctgaacctggccctgctggtgctgcacaaggccttcagaggcaccggcaccgcctacgtggccgaggccatggccagaaaggacaacggcagcatggcccacttcgccctggagatcagaaagaagttccccaccaacgccctgctggccgccctgatcgactacatcgtgtacctgcagagcctgggcgagatcgccaccttcgagctggacgaggactgggagggcttcaagtacaagcccgagcccaccgagagcaccccccaggtgagaagccacagaaacgaccagtacaacttcaagaacgccgagagcaacagcgacaccaaggtgtgcaagaacgtgcagaaggtgctgtgcatcagccccagaagcaaggccaagttcaagaacatcatcgcctgcggcgagcacgccaaccccagcgtgtacatgatgcccaacgtgagcatctaccagagcaacagcgagagaagccactactgcatcgccgacagccactgcctggagaagtacgaggtggtggagaccgagctgctgaacgccctgaagaagagcaagtgctgggccaaggagatggacgacatcatcctgcacaagcagagcgacggcctgagaagctgcagaatcaaggacaccggcaactgcaacgtgcaggagaacgactggaccatcgtgctgtgcgagaacggcaactactactacagcgaggtgcacaaggactacgacaaggaccaggacgtgggccacttctgcctgagccccagatgcaccaccatcagataccccatcagcaagagacacatcaagaagtgcgagtggcagatcagccacagcaccatcgacaagatcagcgtgcaggagctggccgacatcgagcagtacaagaaggccatcagccagaagctgcagaccagcctgagcatcttcaagtacgtgagaaccaagaacctgccccacatcaagcccgcctacaagtacatcaccgtggagggcgtggagaccatcgagggcatcgagaacgccttcatcgagagcgagatccccgccctggccggcaccgccatcggcttcaagatcaacagcagagagggcaactacctgatggacgtgatcggctacgtgaagagcgccagctacagcgccgtgtacaccaagctgtacaccaccggccccaccatcggcatcaacaccaagcacgacgagaagtgcaccggcccctgccccgccatcatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagagtgatcgccatcaagaaccacgagatcaaggtgggccagatcaacgacctgggcgtgtacagcaagggctgcggcaacgtgcagaaggtgaacggcaccaactacggcaacggcagccccagattcgactacctgtgccacctggccagcagaaaggaggtgatcctgagaaagtgcttcgacaacgactaccaggcctgcaagttcctgcagagccccagcagctacagactggaggagcaccagggcaccgtgaccgtgatcgactacaagaagatcctgggcaccatcaagatgaaggccatcctgggcgacgtgaagtacaagaactaccagaacaacatcgagatcaacgccgagggcacctgcgccggctgcatcgactgcttcgagaacatccactgcgagttcaccatccacaccaccgtggaggccagctgccccatcaccaccgagtgcgtgagcttccacgacagaatcctgatcacccccgacgagcacaagtacgccctgaagatcgtgtgccacgacaagcccaaggtgagcctgaagttcaagatctgcaacaccaacgtggacgccgccatgaccatcgtggacagcaagcccatcctggagctggcccccgtggaccagaccacctacatcagagagaaggacgagagatgcaagacctggatgtgcagagtgagagacgagggcttccaggtgatcctggagcccttcaagaacctgttcggcagctacatcggcatcttctacaccggcatcctgagcatcatctgcctgctgatcgtggtgtacatcatcctgcccatctgcttcaagctgagagacaccctgagacagcacgaggacgcctacaagaaggagatgaagatcagatga

SEQ ID NO: 9362 - RNA, 4335 nt, synthetic construct
  misc_feature 1..4335: note = derived and/or modified CDS sequence (opt4) from JCV(3573-03)__HM007354.1__GP
  source 1..4335: mol_type = other RNA
atggaggtgctgagcctgatctggctgctgaccctgtgcagcgccagccccgtgttccagagatgcttccaggacggcgccatcgtgaagcagaaccccagcaaggaggccgtgaccgaggtgtgcctgaaggacgacgtgagcatgatcaagaccgaggccaagtacgtgaagaacaccaccggcaccttcgccaacaacatcgccatgagaaagtggctggtggccgactggcacgactgcagaccccagaagagcagcggcggccacatcaacgtgatcgaggtgggcgacgacctgagcctgcacaccgagagctacatctgcagcgccgactgcgtgatcaccgtggacaaggagaccgcccagatcagactgcagaccgacaacaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccagcagcatcgccaacagcatctgccagaacatcgagatcatcatcctggtgaccctgagcctgaccatcttcatcttcctgaccatcgtgagcaagacctacatctgctacctgctgatgcccgtgttcatccccatcgccttcgtgtacggctggatctacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcatgaccgccgtgctgatcctgaccttcgtgacccccatcagcgccatgatgatcggcgagagcagcgaggtgtacaccctggacgacctgcccgacgacatggtgcagatggccgagagagtgaacatctactaccagatcatcatcatcaactacggcgtgacctgggccttcctgctgctgggcctggtgctggcctacttcttcaagaagtaccagcacaagttcctggacttctacgccatgtactgcaacgagtgcgacatgtaccacgagaaggccggcctgacccactggggcgacttcaccaacagatgcagacagtgcacctgcggccagtacgaggacgtgaccggcctgatcgtgcacaagaagagctacaactgcctggtgaagtacaaggccaagtggatcagagacatcctgatcacctacctgatcatcatcctggtgaaggacagcctgctgttcgtgggcgccaccggcaccgacttcgccgcctgcatcgacgagaagaccgtgacctggaactgcaccggccccttcctgaacctgggcagatgcgacaagagccagaagaagaccagctacaacgacatcgccaaccagctgaagggcctgggcgtgatcagcgtgctggacatccccatgatcaagagaatgcccgacgagatcagcggcagcctgaagtacatcgacaacctggagacctaccacgagcagctgaccgccgagtacgccttcctgaccagatactgcgactactacacccagtacaccgacaacagcggctacagccagaccgtgtggagaacctacctgagaagccacgacttcggcgcctgcgtggtgtaccccaaccagcacttctgcagatgcgtgaagtacggcgacaagtgcaacagcgccaagtgggacttcgccaacgagatgaagaccttctacaccggccagaagatcaagttcaacaaggacctgaacctggccctgctggtgctgcacaaggccttcagaggcaccggcaccgcctacatcgccgaggccatggccagaaaggacaacggcagcatggcccacttcgccctggaggtgagaaagaagttccccaccaacgccctgctggccgccctgatcgactacatcgtgtacctgcagagcctggccgagatcagcaccttcgagctggacgaggactgggaggacttcaagtacaagcccgagcccaccgagagccccagccaggccagaagccacagaagcgaccagtacaacttcaagaacgccgagagcaacagcaacgtgaaggtgtgcaagaacatccagaaggtgctgtgcatcagccccagaagcagagccaagttcgagaacatcatcgcctgcggcgagcacgccaaccccagcgtgtacatgatgcccaacgtgagcatctaccagagcaacagcgagagaagccactactgcatcgccgacagccactgcctggaggactacgagatcgtggagaccgagctgctgagcgccctgaagaagagcaagtgctgggccaaggagatggacgacatcgtgctgcacaagcagagcgacggcctgagaagctgcagaatgaaggacaccggcaactgcgacgtgcaggagaacgactggaccatcgtgctgtgcgagaacggcaactactactacagcgagatccacaaggactacgacaaggaccaggacgtgggccacttctgcctgagccccagatgcagcaccatcagataccccatcaacaagagacacatcaagagatgcaactggcagatcagccacagcaccatcgacaagatcagcgtgcaggagctggccgacatcgagcagtacaagaaggccatcagccagaagctgcagaccagcctgagcatcttcaagtacgtgaagaccaagaacctgccccacatcaagcccgcctacaagtacatcaccgtggagggcatcgagaccgtggagggcatcgagaacgccttcatcgagagcgagatccccgccctggccggcaccgccatcggcttcaagatcaacagcagagagggcaactacctgatggacgtgatcggctacgtgaagagcgccagctacagcgccacctacaccaagctgtacaccaccggccccaccatcggcatcaacaccagacacgacgagaagtgcaccggcccctgccccgccgtgatcgaccacaaggacggctggctgaccttcagcaaggagagaaccagcacctggggctgcgaggagttcggctgcctggccgtgagcgacggctgcgtgttcggcagctgccaggacatcatcaaggacgagctggccgtgtacagaaagaccaccgaggagctgaccaccgtggagctgtgcctgaccttcagcgacaagacctactgcaccaacctgaacgccatcacccccatcatcaccgacaagttcgaggtgcagttcaagaccgtggagagctacaccctgcccagagtgatcgccgtgaagaaccacgagatcaaggtgggccagatcaacgacctgggcgtgtacagcaagggctgcggcaacgtgcagaaggtgaacggcaccaactacggcaacggcatgcccaagttcgactacctgtgccacctggccagcagaaaggaggtgatcctgagaaagtgcttcgacaacgactaccaggcctgcaagttcctgcagagccccagcagctacagactggaggagcaccagggcaccgtgaccatcatcgactacaagaagatcctgggcaccatcaagatgaaggccatcctgggcgacgtgaagtacaagaactaccagagcaacatcgagatcaacgccgagggcacctgcgccggctgcatcaactgcttcgagaacatccactgcgagttcaccatccacaccaccgtggaggccagctgccccatcgtgaccgactgcgtgagcttccacgacagaatcctgatcacccccgacgagcacaagtacgccctgaaggtggtgtgccaggacaagcccaaggtgagcctgaagttcaagatctgcaacaccaacatcgacgccagcatgaccatcgtggacagcaagcccatcctggagctggcccccgtggaccagaccgcctacatcaaggagaaggacgagagatgcaagacctggatgtgcagagtgagagacgagggcttccaggtgatcctggagcccttcaagaacctgttcggcagctacatcggcatcttctacaccggcatcctgagcgtgatctgcctgctgatcgtgatctacatcatcctgcccatctgcttcaagctgagagacaccctgagacagcacgaggacgcctacaagaaggagatgaagatcagatga

SEQ ID NO: 9363 - RNA, 4335 nt, synthetic construct
  misc_feature 1..4335: note = derived and/or modified CDS sequence (opt4) from KEYV(KEYV/Ochlerotatus atlanticus/USA/KEYVLK01/2005)__KT630289.1__GP
  source 1..4335: mol_type = other RNA
atgatgatctggatcctgctgaccgtggtgaccgtgaccatcgccaaccccgtgtaccagagatgcttccaggacggcgccatcgtgaagcagaaccccagcaaggaggccgtgaccgaggtgtgcctgaaggacgacgtgagcatgatcaagaccgaggccaagtacgtgaagaacctgaccggcaccttcagcaacaacgtggccatgagaaagtggctggtggccgactggcacgactgcagaccccagaagagagccggcggccacatcaacgtgatcgaggtgggcgacgacctgagcctgcacaccgagagctacatctgcagcgccgactgcgtgatcagcgtggacaaggagaccgcccagatcagactgcagaccgacaccaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacatcctgatgcccatcttcatccccatcgcctacatctacggctgggtgtacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccgtgctgatcctgaccttcatcacccccatgaacgccatggtgctgggcagcagcgaggaggtgtacaagctggaggacctgcccgacgacatgctgaacatggccgagaagatcgacatctactacctgagcatcgtgctgaactacagcaccacctggggcctgctgatcctgctgctgatcgtgagctgcctgttcaagaagtaccagcacgtgttcctgaactactacgccatgtactgccacgagtgcgacatgtaccacgagaagaagaacctggtgtacaacggcgacttcagcaacaagtgcagacagtgcacctgcggccagtacgaggacgccaccggcctgatcgtgcaccagaagagctacaactgcctgatcaagtacaaggccaagtggttcatcaacatcctgatcatctacaccatcctggtgctgctgaaggacagcgtgctgatggccgccgccgagggccccgacttcaacacctgcatcgagcagagaagcatcagcctgaactgcaccggccccttcatcaacctgggcggctgcgagaagccccagaagagagccagctaccagagcatcgccgagcagctgaaggccatcaacgccatcagcatcctggacatgcccatgatcagcaagatccccgacgacatcagcggcgccctgagacacatcgagaacctgaagacctaccacgagcagctgaccgccgagttcgccatgctgaccagatactgcgactactacacccagttcagcgacaacagcggctacagccagaccagctggagaacctacctgagaagccacgacttcgaggtgtgcatcgcctaccccaaccagcacttctgcagatgcgtgaagaacggcgagaagtgcaccagcgccaactgggacttcgccaacgagatgaagaactactacaccggcaagcagatcagattcgacaaggacctgaacctggccctgaccaccctgcacaccgccttcagaggcaccagcacctactacatgagcgacatcctggccgagaccaaggccaacagcctgagagactacgccctggccctgaagagcaagtaccccggcaacgccctgctgaaggccatcctggacttcatcatgtacctgcagagcctgaacgaggccaccaagttcaagctgagcagcgactgggaggacttcaagtacaacagcgagctggaggccagagccctgatgcccagagccagaagcagcggcgactacaacttcagcaacgccgagagcaccaacaaggtgaagatctgcaagaacatccagagagtgatgtgcctgagccccagaagcaaggccaccgtggaggacatcatcgcctgcggcgagcacgagcaccccagcgtgtacatggtgcccaacaccaccatctaccagagcaacatcgagagaagccactactgcatcgccgacagccactgcctggaggagtacgagctggtgcagaacgagctgctgaccgccctgaagaagagcacctgctggaccggcgagctggagaacgtgatcccccacaagcagagcgacggcatcagaagctgcagaaccaagaacaccggcagatgcaacgtgaagggcgaggactggaccgtgatcctgtgcgagaacgacaagtactactacagcgagctgaacaaggactacgacaaggaccaggacatcggccacgtgtgcctgagccccagatgcaacagcatcagataccccatcagccccagacacatcaccaactgcaagtgggagaaccccgccggcaccatcagcagaatcgagacccacagcctggccgacatcgagcagtacaagaaggccatcagccagaagctgcagaacagcctgaccatcttcaagtacgagaagaccaagaacctgccccacatcaagcccatctacaagtacatcaccatcgagggcaccgagaccgtggagggcgtggagaacgccttcatcgaggccgagatccccgccctggccggcaccagcatcggcttcaaggtgaacagcagagacggcgaccacctgatggacatcatcgcctacatcaaggtggccagctacagcagcacctacaccaagctgtacaccaccggccccaccatcggcatcaacaccaagcacgacgagaagtgcaccggcaactgccccgccagactggagcacaaggtgggctggctgaccttcgccaaggagagaaccagcacctggggctgcgaggagttcggctgcctggccgtgagcgacggctgcgtgttcggcagctgccaggacatcatcaaggaggagctgagcgtgtacagaaaggacaccgaggaggtgagcaacgtggagctgtgcctgaccttcgccgacaagacctactgcaccagcctgaacgccatcacccccatcatcaccgagaagttcgaggtgcagttcaagaccgtggagagctacagcctgcccagaatcgtgggcatcagaaaccacgagatcagaatcggccagatcaacgacctgggcagctacagcaagggctgcggcaacgtgcagagagtgaacggcaccaactacggcagcggccagcccaagttcgactacctgtgccacctggccagcagaaaggaggtgatcgtgagaaagtgcttcgacaacgactaccaggcctgcaagttcctgcagacccccagcagctacagactggaggagcacgagggcaccgtgaccatcatcgactacaagaagatcctgggcaccatcaagatgaaggccatcctgggcgacgtgagatacaagaactacgccagcgccatcgacatcaacgccgagggcgtgtgcgccggctgcatcaactgcttcgagaacatccactgcgagttcaccatccacaccaccatcgaggccagctgccccatcgagagcgactgcgtgagcttccacgacagaatcctggtgacccccaacgagcacaagtacgccctgaagctgatctgcgaggacaagcccggcagcaccctgaagttcaagatctgcaacaccaagatcgacgccgccatgaccctggtggacgccaagcccatcctggagctggcccccgtggaccagaccgcctacatcagagagaaggacgagagatgcaagacctggatgtgcagagtgagagacgagggcatcaaggtgctgctggagcccttcaagaacctgttcggcagctacatcggcatcgtgtacagcatcatcctgatcatcatcgccgccatcatcatcatctacatcatcctgcccatctgcttcaagctgagagacaccctgaagaagcacgaggacgcctacagaaaggagatgaagatcagatga

SEQ ID NO: 9364 - RNA, 4332 nt, synthetic construct
  misc_feature 1..4332: note = derived and/or modified CDS sequence (opt4) from KEYV(KEYV/Ochlerotatus atlanticus/USA/KEYVLK01/2005)__KT630289.1__GP
  source 1..4332: mol_type = other RNA
atgatctggatcctgctgaccgtggtgaccgtgaccatcgccaaccccgtgtaccagagatgcttccaggacggcgccatcgtgaagcagaaccccagcaaggaggccgtgaccgaggtgtgcctgaaggacgacgtgagcatgatcaagaccgaggccaagtacgtgaagaacctgaccggcaccttcagcaacaacgtggccatgagaaagtggctggtggccgactggcacgactgcagaccccagaagagagccggcggccacatcaacgtgatcgaggtgggcgacgacctgagcctgcacaccgagagctacatctgcagcgccgactgcgtgatcagcgtggacaaggagaccgcccagatcagactgcagaccgacaccaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacatcctgatgcccatcttcatccccatcgcctacatctacggctgggtgtacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccgtgctgatcctgaccttcatcacccccatgaacgccatggtgctgggcagcagcgaggaggtgtacaagctggaggacctgcccgacgacatgctgaacatggccgagaagatcgacatctactacctgagcatcgtgctgaactacagcaccacctggggcctgctgatcctgctgctgatcgtgagctgcctgttcaagaagtaccagcacgtgttcctgaactactacgccatgtactgccacgagtgcgacatgtaccacgagaagaagaacctggtgtacaacggcgacttcagcaacaagtgcagacagtgcacctgcggccagtacgaggacgccaccggcctgatcgtgcaccagaagagctacaactgcctgatcaagtacaaggccaagtggttcatcaacatcctgatcatctacaccatcctggtgctgctgaaggacagcgtgctgatggccgccgccgagggccccgacttcaacacctgcatcgagcagagaagcatcagcctgaactgcaccggccccttcatcaacctgggcggctgcgagaagccccagaagagagccagctaccagagcatcgccgagcagctgaaggccatcaacgccatcagcatcctggacatgcccatgatcagcaagatccccgacgacatcagcggcgccctgagacacatcgagaacctgaagacctaccacgagcagctgaccgccgagttcgccatgctgaccagatactgcgactactacacccagttcagcgacaacagcggctacagccagaccagctggagaacctacctgagaagccacgacttcgaggtgtgcatcgcctaccccaaccagcacttctgcagatgcgtgaagaacggcgagaagtgcaccagcgccaactgggacttcgccaacgagatgaagaactactacaccggcaagcagatcagattcgacaaggacctgaacctggccctgaccaccctgcacaccgccttcagaggcaccagcacctactacatgagcgacatcctggccgagaccaaggccaacagcctgagagactacgccctggccctgaagagcaagtaccccggcaacgccctgctgaaggccatcctggacttcatcatgtacctgcagagcctgaacgaggccaccaagttcaagctgagcagcgactgggaggacttcaagtacaacagcgagctggaggccagagccctgatgcccagagccagaagcagcggcgactacaacttcagcaacgccgagagcaccaacaaggtgaagatctgcaagaacatccagagagtgatgtgcctgagccccagaagcaaggccaccgtggaggacatcatcgcctgcggcgagcacgagcaccccagcgtgtacatggtgcccaacaccaccatctaccagagcaacatcgagagaagccactactgcatcgccgacagccactgcctggaggagtacgagctggtgcagaacgagctgctgaccgccctgaagaagagcacctgctggaccggcgagctggagaacgtgatcccccacaagcagagcgacggcatcagaagctgcagaaccaagaacaccggcagatgcaacgtgaagggcgaggactggaccgtgatcctgtgcgagaacgacaagtactactacagcgagctgaacaaggactacgacaaggaccaggacatcggccacgtgtgcctgagccccagatgcaacagcatcagataccccatcagccccagacacatcaccaactgcaagtgggagaaccccgccggcaccatcagcagaatcgagacccacagcctggccgacatcgagcagtacaagaaggccatcagccagaagctgcagaacagcctgaccatcttcaagtacgagaagaccaagaacctgccccacatcaagcccatctacaagtacatcaccatcgagggcaccgagaccgtggagggcgtggagaacgccttcatcgaggccgagatccccgccctggccggcaccagcatcggcttcaaggtgaacagcagagacggcgaccacctgatggacatcatcgcctacatcaaggtggccagctacagcagcacctacaccaagctgtacaccaccggccccaccatcggcatcaacaccaagcacgacgagaagtgcaccggcaactgccccgccagactggagcacaaggtgggctggctgaccttcgccaaggagagaaccagcacctggggctgcgaggagttcggctgcctggccgtgagcgacggctgcgtgttcggcagctgccaggacatcatcaaggaggagctgagcgtgtacagaaaggacaccgaggaggtgagcaacgtggagctgtgcctgaccttcgccgacaagacctactgcaccagcctgaacgccatcacccccatcatcaccgagaagttcgaggtgcagttcaagaccgtggagagctacagcctgcccagaatcgtgggcatcagaaaccacgagatcagaatcggccagatcaacgacctgggcagctacagcaagggctgcggcaacgtgcagagagtgaacggcaccaactacggcagcggccagcccaagttcgactacctgtgccacctggccagcagaaaggaggtgatcgtgagaaagtgcttcgacaacgactaccaggcctgcaagttcctgcagacccccagcagctacagactggaggagcacgagggcaccgtgaccatcatcgactacaagaagatcctgggcaccatcaagatgaaggccatcctgggcgacgtgagatacaagaactacgccagcgccatcgacatcaacgccgagggcgtgtgcgccggctgcatcaactgcttcgagaacatccactgcgagttcaccatccacaccaccatcgaggccagctgccccatcgagagcgactgcgtgagcttccacgacagaatcctggtgacccccaacgagcacaagtacgccctgaagctgatctgcgaggacaagcccggcagcaccctgaagttcaagatctgcaacaccaagatcgacgccgccatgaccctggtggacgccaagcccatcctggagctggcccccgtggaccagaccgcctacatcagagagaaggacgagagatgcaagacctggatgtgcagagtgagagacgagggcatcaaggtgctgctggagcccttcaagaacctgttcggcagctacatcggcatcgtgtacagcatcatcctgatcatcatcgccgccatcatcatcatctacatcatcctgcccatctgcttcaagctgagagacaccctgaagaagcacgaggacgcctacagaaaggagatgaagatcagatga

SEQ ID NO: 9365 - RNA, 4332 nt, synthetic construct
  misc_feature 1..4332: note = derived and/or modified CDS sequence (opt4) from KEYV(KEYV/Ochlerotatus atlanticus/USA/KEYVLK02/2005)__KT630292.1__GP
  source 1..4332: mol_type = other RNA
atgatctggatcctgctgaccgtggtgaccgccaccatcgccaaccccgtgtaccagagatgcttccaggacggcgccatcgtgaagcagaaccccagcaaggaggccgtgaccgaggtgtgcctgaaggacgacgtgagcatgatcaagaccgaggccaagtacgtgaagaacctgaccggcaccttcagcaacaacgtggccatgagaaagtggctggtggccgactggcacgactgcagaccccagaagagagccggcggccacatcaacgtgatcgaggtgggcgacgacctgagcctgcacaccgagagctacatctgcagcgccgactgcgtgatcagcgtggacaaggagaccgcccagatcagactgcagaccgacaccaccaaccacttcgaggtggccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacatcctgatgcccatcttcatccccatcgcctacatctacggctgggtgtacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccgtgctgatcctgaccttcatcacccccatgaacgccatggtgctgggcagcagcgaggaggtgtacaagctggaggacctgcccgacgacatgctgaacatggccgagaagatcgacatctactacctgagcatcgtgctgaactacagcaccacctggggcctgctgatcctgctgctgatcgtgagctgcctgttcaagaagtaccagcacgtgttcctgaactactacgccatgtactgccacgagtgcgacatgtaccacgagaagaagaacctggtgtacaacggcgacttcagcaacaagtgcagacagtgcacctgcggccagtacgaggacgccaccggcctgatcgtgcaccagaagagctacaactgcctgatcaagtacaaggccaagtggttcatcaacatcctgatcatctacaccatcctggtgctgctgaaggacagcgtgctgatggccgccgccgagggccccgacttcaacacctgcatcgagcagagaagcatcagcctgaactgcaccggccccttcatcaacctgggcggctgcgagaagccccagaagagagccagctaccagagcatcgccgagcagctgaaggccatcaacgccatcagcatcctggacatgcccatgatcagcaagatccccgacgacatcagcggcgccctgagacacatcgagaacctgaagacctaccacgagcagctgaccgccgagttcgccatgctgaccagatactgcgactactacacccagttcagcgacaacagcggctacagccagaccagctggagaacctacctgagaagccacgacttcgaggtgtgcatcgcctaccccaaccagcacttctgcagatgcgtgaagaacggcgagaagtgcaccagcgccaactgggacttcgccaacgagatgaagaactactacaccggcaagcagatcagattcgacaaggacctgaacctggccctgaccaccctgcacaccgccttcagaggcaccagcacctactacatgagcgacatcctggccgagaccaaggccaacagcctgagagactacgccctggccctgaagagcaagtaccccggcaacgccctgctgaaggccatcctggacttcatcatgtacctgcagagcctgaacgaggccaccaagttcaagctgagcagcgactgggaggacttcaagtacaacagcgagcccgaggccagagccctgatgcccagagccagaagcagcggcgactacaacttcagcaacgccgagagcaccaacaaggccaaggtgtgcaagaacatccagagagtgatgtgcctgagccccagaagcaaggccaccgtggaggacatcatcgcctgcggcgagcacgagcaccccagcgtgtacatggtgcccaacaccaccgtgtaccagagcaacatcgagagaagccactactgcatcgccgacagccactgcctggaggagtacgagctggtgcagaacgagctgctgaccgccctgaagaagagcacctgctggaccggcgagctggagaacgtgatcccccacaagcagagcgacggcaccagaagctgcagaaccaagaacaccggcagatgcaacgtgaagggcgaggactggaccgtgatcctgtgcgagaacgacaagtactactacagcgagctgaacaaggactacgacaaggaccaggacatcggccacgtgtgcctgagccccagatgcaacagcatcagataccccatcagccccagacacatcaccaactgcaagtgggagaaccccgccggcaccatcagcagaatcgagacccacagcctggccgacatcgagcagtacaagaaggccatcagccagaagctgcagaacagcctgaccatcttcaagtacgagaagaccaagaacctgccccacatcaagcccatctacaagtacatcaccatcgagggcaccgagaccgtggagggcgtggagaacgccttcatcgaggccgagatccccgccctggccggcaccagcatcggcttcaaggtgaacagcagagacggcgaccacctgatggacatcatcgcctacatcaaggtggccagctacagcagcacctacaccaagctgtacaccaccggccccaccatcggcatcaacaccaagcacgacgagaagtgcaccggcaactgccccgccagactggagcacaaggtgggctggctgaccttcgccaaggagagaaccagcacctggggctgcgaggagttcggctgcctggccgtgagcgacggctgcgtgttcggcagctgccaggacatcatcaaggaggagctgagcgtgtacagaaaggacaccgaggaggtgaccaacgtggagctgtgcctgaccttcgccgacaagacctactgcaccagcctgaacgccatcacccccatcatcaccgagaagttcgaggtgcagttcaagaccgtggagagctacagcctgcccagaatcgtgggcatcagaaaccacgagatcagaatcggccagatcaacgacctgggcagctacagcaagggctgcggcaacgtgcagagagtgaacgacaccaactacggcagcggccagcccaagttcgactacctgtgccacctggccagcagaaaggaggtgatcgtgagaaagtgcttcgacaacgactaccaggcctgcaagttcctgcagacccccagcagctacagactggaggagcacgagggcaccgtgaccatcatcgactacaagaagatcctgggcaccatcaagatgaaggccatcctgggcgacgtgagatacaagaactacgccagcgccatcgacatcaacgccgagggcgtgtgcgccggctgcatcaactgcttcgagaacatccactgcgagttcaccatccacaccaccatcgaggccagctgccccatcgagagcgactgcgtgagcttccacgacagaatgctggtgacccccaacgagcacaagtacgccctgaagctgatctgcgaggacaagcccggcagcaccctgaagttcaagatctgcaacaccaagatcgacgccgccatgaccctggtggacgccaagcccatcctggagctggcccccgtggaccagaccgcctacatcagagagaaggacgagagatgcaagacctggatgtgcagagtgagagacgagggcatcaaggtgctgctggagcccttcaagaacctgttcggcagctacatcggcatcgtgtacagcatcatcctgatcatcatcgccgccatcatcatcatctacgtgatcctgcccatctgcttcaagctgagagacaccctgaagaagcacgaggacgcctacagaaaggagatgaagatcagatga

SEQ ID NO: 9366 - RNA, 4332 nt, synthetic construct
  misc_feature 1..4332: note = derived and/or modified CDS sequence (opt4) from KEYV(C14031-33)__AF123489.1__GP
  source 1..4332: mol_type = other RNA
atgatctggatcctgctgaccgtggtgaccgtgaccatcgccaaccccgtgtaccagagatgcttccaggacggcgccatcgtgaagcagaaccccagcaaggaggccgtgaccgaggtgtgcctgaaggacgacgtgagcatgatcaagaccgaggccaagtacgtgaagaacctgaccggcaccttcagcaacaacgtggccatgagaaagtggctggtggccgactggcacgactgcagaccccagaagagagccggcggccacatcaacgtgatcgaggtgggcgacgacctgagcctgcacaccgagagctacatctgcagcgccgactgcgtgatcagcgtggacaaggagaccgcccagatcagactgcagaccgacaccaccaaccacttcgaggtggccggcaccaccgtgaagagcggctggttcaagagcaccacctacatcaccctggaccagacctgcgagagactgaaggtgagctgcggccccaagagcatccagttccacgcctgcttcaaccagcacatgagctgcgtgagattcctgcacagaaccatcctgctgggcagcatcgccaacagcatctgccagaacatcgagatcatcatcctggtgaccctgaccctgctgatcttcatcctgctgagcatcctgagcaagacctacatctgctacatcctgatgcccatcagcatccccatcgcctacatctacggctgggtgtacaacaagagctgcaagaagtgcaagctgtgcggcctggtgtaccaccccttcaccgagtgcggcacccactgcgtgtgcggcgccagatacgagaccagcgacagaatgaagctgcacagagccagcggcctgtgccccggctacaagagcctgagagccgccagagtgatgtgcaagagcaagggccccgccagcatcctgagcatcctgaccgccgtgctgatcctgaccttcatcacccccatgaacgccatggtgctgggcagcagcgaggaggtgtacaagctggaggacctgcccgacgacatgctgaacatggccgagaagatcgacatctactacctgagcatcgtgctgaactacagcaccacctggggcctgctgatcctgctgctgatcgtgagctgcctgttcaagaagtaccacctggtgttcctgaactactacgccctgtactgccacgagtgcgacatgtaccacgagaagaagaacctggtgtacaacggcgacttcagcaacaagtgcctgcagtgcacctgcggccagtacgaggacgccaccggcctgatcgtgcaccagaagagctacaactgcctgatcaactacaaggccaagtggttcatcaacatcctgatcatctacaccatcctggtgctgctgaaggacagcgtgctgatggccgccgccgagagacccgacttcaacacctgcatcgagcagagaagcatcagcctgaactgcaccggccccttcatcaacctgggcggctgcaagaagccccagaagagagccagctaccagagcatcgccgagcagctgaaggccatcaacgccatcagcatcctggacatgcccatgatcagcaagatccccgacgacatcagcggcgccctgagacacatcgagaacctgaagacctaccacgagcagctgaccgccgagttcgccatgctgaccagatactgcgactactacacccagttcagcgacaacagcggctacagccagaccagctggagaacctacctgagaagccacgacttcgaggtgtgcatcgcctaccccaaccagcacttctgcagatgcgtgaagaacggcgagaagtgcaccagcgccaactgggacttcgccaacgagatgaagaactactacaccggcaagcagatcagattcgacaaggacctgaacctggccctgaccaccctgcacaccgccttcagaggcaccagcacctactacatgagcgacatcctggccgagaccaaggccaacagcctgagagactacgccctggccctgaagagcaagtaccccggcaacgccctgctgaaggccatcctggacttcatcatgtacctgcagcccctgaacgaggccaccaagttcaagctgagcagcgactgggaggacttcaagtacaacagcgagcccgaggccagagccctgatgcccagagccagaagcagcggcgactacaacttcagcaacgccgagagcaccaacaaggtgaaggtgtgcaagaacatccagagagtgatgtgcctgagccccagaagcaaggccaccgtggaggacatcatcgcctgcggcgagcacgagcaccccagcgtgtacatggtgcccaacaccaccatctaccagagcaacatcgagagaagccactactgcatcgccgacagccactgcctggaggagtacgagctggtgcagaacgagctgctgaccgccctgaagaagagcacctgctggaccggcgagctggagaacgtgatcccccacaagcagagcgacggcatcagaagctgcagaaccaagaacaccggcagatgcaacgtgaagggcgaggactggaccgtgatcctgtgcgagaacgacaagtactactacagcgagctgaacaaggactacgacaaggaccaggacatcggccacgtgtgcctgagccccagatgcaacagcatcagataccccatcagccccagacacatcaccaactgcaagtgggagaaccccgccggcaccatcagcagaatcgagacccacagcctggccgacatcgagcagtacaagaaggccatcagccagaagctgcagaacagcctgaccatcttcaagtacgagaagaccaagaacctgccccacatcaagcccatctacaagtacatcaccatcgagggcaccgagaccgtggagggcgtggagaacgccttcatcgaggccgagatccccgccctggccggcaccagcatcggcttcaaggtgaacagcagagacggcgaccacctgatggacatcatcgcctacatcaaggtggccagctacagcagcacctacaccaagctgtacaccaccggccccaccatcggcatcaacaccaagcacgacgagaagtgcaccggcaactgccccgccagactggagcacaaggtgggctggctgaccttcgccaaggagagaaccagcacctggggctgcgaggagttcggctgcctggccgtgagcgacggctgcgtgttcggcagctgccaggacatcatcaaggaggagctgagcgtgtacagaaaggacaccgaggaggtgaccaacgtggagctgtgcctgaccttcgccgacaagacctactgcaccagcctgaacgccatcacccccatcatcaccgagaagttcgaggtgcagttcaagaccgtggagagctacagcctgcccagaatcgtgggcatcagaaaccacgagatcagaatcggccagatcaacgacctgggcagctacagcaagggctgcggcaacgtgcagagagtgaacggcaccaactacggcagcggccagcccaagttcgactacctgtgccacctggccagcagaaaggaggtgatcgtgagaaagtgcttcgacaacgactaccaggcctgcaagttcctgcagacccccagcagctacagactggaggagcacgagggcaccgtgaccatcatcgactacaagaagatcctgggcaccatcaagatgaaggccatcctgggcgacgtgagatacaagaactacgccagcgccatcgacatcaacgccgagggcgtgtgcgccggctgcatcaactgcttcgagaacatccactgcgagttcaccatccacaccaccatcgaggccagctgccccatcgagagcgactgcgtgagcttccacgacagaatgctggtgacccccaacgagcacaagtacgccctgaagctgatctgcgaggacaagcccggcagcgccctgaagttcaagatctgcaacaccaagatcgacgccgccatgaccctggtggacgccaagcccatcctggagctggcccccgtggaccagaccgcctacatcagagagaaggacgagagatgcaagacctggatgtgcagagtgagagacgagggcatcaaggtgctgctggagcccttcaagaacctgttcggcagctacatcggcatcgtgtacagcatcatcctgatcatcatcgccgccatcatcatcatctacatcatcctgcccatctgcttcaagctgagagacaccctgaagaagcacgaggacgcctacagaaaggagatgaagatcagatga

SEQ ID NO: 9367 - RNA, 4326 nt, synthetic construct
  misc_feature 1..4326: note = derived and/or modified CDS sequence (opt4) from LACV(Human/78)__NC_004109.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatga

SEQ ID NO: 9368 - RNA, 4326 nt, synthetic construct
  misc_feature 1..4326: note = derived and/or modified CDS sequence (opt4) from LACV__KP271111.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcagcatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaaggccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcaaccaggaggagctggacgccgtgaagaagagcaagtgctgggagatcgagtacagcgacgtgaagcccctgcaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaagatcaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcgtgtacgtgctgctgcccatctgcttcaagctgagagacaccctgagaaagcacgaggacgcctacaagagagagatgaagatcagatga

SEQ ID NO: 9369 - RNA, 4326 nt, synthetic construct
  misc_feature 1..4326: note = derived and/or modified CDS sequence (opt4) from LACV__M87664.1__GP
  source 1..4326: mol_type = other RNA
atgatctgcatcctggtgctgatcaccgtggccaccgccagccccgtgctgcagagatgcttccaggacggcgccatcgtgaagcagaaccccagcaaggaggccttcaccgaggtgtgcctgaaggacgacgtgagcatgatcaagaccgaggccagatacgtgagaaacgccaccggcgtgttcagcaacaacgtggccatcagaaagtggctggtgagcgcctggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcagaagcaccacctacatcaccctggaccagacctgcgagcacctgaaggtgagctgcggccccaagagcgtgcagttccacgcctgcttcaaccagcacatgagctgcgtgagattcctgcacagaaccatcctgcccagaagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcaccatctacaacaagagctgcaagaagtgcaagctgtgcggcctggcccaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactaccccacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcgtgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaacagagacttcgccaacgagatgaaggactactacagcggcaagcagaccaagttcgacaaggacctgaacctggccctgaccgccctgcacagccaggtgatgcactgcagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgacccagtgcgagaacgacaagttctactacagcgacctgcagaaggactacgacaagacccaggacatcggccactactgcctgagccccggctgcaccaccgtgagataccccatcaaccccaagcacatcagcaactgcaactggcaggtgagcagaagcagcatcgccgagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatgaagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccaacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9370 - RNA, 4326 nt, synthetic construct
  misc_feature 1..4326: note = derived and/or modified CDS sequence (opt4) from LACV__KP271105.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcagcatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaaggccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccagcggccccagcgtgtacagaaagcccagcggcggcgtgttccagagcagcaccgacagaagcatctactgcctgctggacagccactgcctggaggagttcgaggccatcaaccaggaggagctggacgccgtgaagaagagcaagtgctgggagatcgagtacagcgacgtgaagcccctgcaggagggcgacggcaccaagagctgcaagatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcgtgtacgtgctgctgcccatctgcttcaagctgagagacaccctgagaaagcacgaggacgcctacaagagagagatgaagatcagatga

SEQ ID NO: 9371 - RNA, 4326 nt, synthetic construct
  misc_feature 1..4326: note = derived and/or modified CDS sequence (opt4) from LACV(74-32813)__D10370.1__GP
  source 1..4326: mol_type = other RNA
atgatcagaatgctggtgctgatcgtggtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcgcccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccctgagaatcaacagctactacttcacctgcatcctgaactacgccgtgagctggggcctgatcatcgccggcctgctggtgggcctgatcttcaagaagtaccagcacagattcctgaacatctacgccatgtactgcgaggagtgcaacatgtaccacgacaagagcggcctgaagagacacggcgacttcaccaacaagtgcagacagtgcacctgcggccagtacgaggacgccaccggcctgatcacccacagaaagacctacaactgcctggtgcagtacaaggccaagtggatgatgaacttcctgatcatctacatcttcctgatcctgatcaaggacagcgccatcgtgggccaggccaccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccagcatccccgacgacatcgccggcgccctgagatacatcgaggagaaggaggacttccacgtgcagctgaccaccgagtacgccatgctgagcaagtactgcgactactacacccagttcagcgacaacagcggctacagccagaccacctggagagtgtacctgagaagccacgacttcgaggcctgcatcctgtaccccaaccagcacttctgcaagtgcgtgaagaacggcgagaagtgcagcagcagcaactgggacttcgccaacggcatgaagaactactacagcggcaagcaggccaagttcgacaaggacctgaacctggccctgaccgccctgcaccacgccttcagaggcaccagcagcgcctacatcgccgccatgctgagcaagaagagcaacgacgacctgatcgcctacaccaacaagatcaaggccaagttccccggcaacgccctgctgaaggccatcatcgactacatcgcctacatgaagggcctgcccgagatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacagcagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgagacccctgcaggagagcgacggcgccaagagctgcagaatgaaggacagcggcaactgcaacgtggccaccaacagatggcccgtgatgcagtgcgagaacgacaagttctactacagcgagctgcagaaggactacgacaagacccaggacatcggccactactgcctgagccccggctgcaccaccatcagataccccatcaaccccaagcacatcagcaactgcaactggcaggtgagcagaagcagcatcgccaagatcgacgtgcacaacgtggaggacatcgagcagtacaagaaggccatcacccagaagctgcagaccagcctgagcctgttcaagtacgccaagaccaagaacctgccccacatcagacccatctacaagtacatcaccatgaaggagaccgagaccgccgagggcatcgagagcgcctacatcgagagcgaggtgcccgccctggccggcaccagcgtgggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccaacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcgccggctgcatcaactgcttccagaacatccactgcgagctgaccctgcacaccaccatcgaggccagctgccccatcaagagcagctgcaccgtgttccacgacagaatcctggtgacccccaacgagcacaagtacgccctgaagatcgtgtgcaccgagaagcccggcaacaccctgaccatcaaggtgtgcaacaccagaatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgccctgctggtgatcatctacgtgctgctgcccatctgcttcaagctgagagacaccctgagaaagcacgacgacgcctacaagagagagatgaagatcagatga

SEQ ID NO: 9372 - RNA, 4326 nt, synthetic construct
  misc_feature 1..4326: note = derived and/or modified CDS sequence (opt4) from LACV(Craig County/VA/2009)__KP226848.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccgtgttcatccccatcgcctgcatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacttcacctgcatcctgaactacgccgtgagctggggcctggtgatcatcggcctgctgatcggcctgctgttcaagaagtaccagcacagattcctgaacatctacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatcatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacggcatgaaggactactacagcggcaagcaggccaagttcgacaaggacctgaacctggccctgaccgccctgcaccacgccttcagaggcaccagcagcgcctacatcgccaccatgctgagcaagaagagcaacgacgacctgatcacctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagagcgacggcaccaagagctgcagaatgaaggacagcggcaactgcaacgtggccaccaacagatggcccatcatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcgccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccatcctggtgatcatctacgtgctgctgcccatctgcttcaagctgagagacaccctgagaaagcacgaggacgcctacaagagagagatgaagatcagatga

SEQ ID NO: 9373 - RNA, 4326 nt, synthetic construct
  misc_feature 1..4326: note = derived and/or modified CDS sequence (opt4) from LACV(Dallas/TX/2009)__GU591165.1__GP
  source 1..4326: mol_type = other RNA
atgatcagaatcctggtgctgatcgtggtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatggcctacatgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccctgagaatcaacagctactacttcacctgcatcctgaactacgccgtgagctggggcctgatcatcgccggcctgctggtgggcctgatcttcaagaagtaccagcacagattcctgaacatctacgccatgtactgcgaggagtgcgacatgtaccacgacaagagcggcctgaagagacacggcgacttcaccagcaagtgcagacagtgcacctgcggccagtacgaggacgccaccggcctgatcacccacagaaagacctacaactgcctggtgcagtacaaggccaagtggatgatgaacttcctgatcatctacatcttcctgatcctgatcaaggacagcgccatcgtggtgcaggccaccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagaaggaggacttccacgtgcagctgaccaccgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaagaactactacagcggcaagcaggccaagttcgacaaggacctgaacctggccctgaccgccctgcaccacgccttcagaggcaccagcagcgcctacatcgccaccatgctgagcaagaagagcaacgacgacctggtggcctacaccaacaagatcaaggccaagttccccggcaacgccctgctgaaggccatcatcgactacatcgcctacatgaagggcctgcccgacatggccaacttcaagtacgacgagttctgggacgagctgctgtacaagcccaaccccgccaaggccagcaacctggccagaggcaaggagagcagctacaacttcaagctggccgtgagcagcaagagcatcagaacctgcaagaacgtgaaggacgtggcctgcctgagccccagaagcggcgccatctacagcagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacatcagacccctgcaggagagcgacggcagcaagagctgcagaatgaaggacagcggcaactgcaacgtggccaccaacagatggcccgtgatgcagtgcgagaacgacaagttctactacagcgagctgcagaaggactacgacaagacccaggacatcggccactactgcctgagccccggctgcaccaccatcagataccccatcaaccccaagcacatcagcaactgcaactggcaggtgagcagaagcagcatcgccaagatcgacgtgcacaacgtggaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggacaccgaggaggtgaccaacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcgccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccagaatcgaggtgagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgccctgctggtgatcatctacgtgctgctgcccatctgcttcaagctgagagacaccctgagaaagcacgacgacgcctacaagagagagatgaagatcagatga

SEQ ID NO: 9374 - RNA, 4326 nt, synthetic construct
  misc_feature 1..4326: note = derived and/or modified CDS sequence (opt4) from LACV(Fort Bend County/TX/2009)__GU591168.1__GP
  source 1..4326: mol_type = other RNA
atgatcagaatgctggtgctgatcgtggtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcagaacctacatctgctacctgctgatgcccatcttcatccccatcgcctacatgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccctgagaatcaacagctactacttcacctgcatcctgaactacgccgtgagctggggcctgatcatcgccggcctgctggtgggcctgatcttcaagaagtaccagcacagattcctgaacatctacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccaccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagaaggaggacttccacatccagctgaccaccgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaagaactactacagcggcaagcaggccaagttcgacaaggacctgaacctggccctgaccgccctgcaccacgccttcagaggcaccagcagcgcctacatcgccaccatgctgagcaagaagagcaacgacgacctgatcgcctacaccaacaagatcaaggccaagttccccggcaacgccctgctgaaggccatcatcgactacatcgcctacatgaagggcctgcccgacatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacagcagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgagacccctgcaggagagcgacggcgccaagagctgcagaatgaaggacagcggcaactgcaacgtggccaccaacagatggcccgtgatgcagtgcgagaacgacaagttctactacagcgagctgcagaaggactacgacaagacccaggacatcggccactactgcctgagccccggctgcaccaccatcagataccccatcaaccccaagcacatcagcaactgcaactggcaggtgagcagaagcagcatcgccaagatcgacgtgcacaacgtggaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccaacgtggagctgtgcctgaccttcagcgacaagacctactgcaccagcctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcgccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccagaatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgccctgctggtgatcatctacgtgctgctgcccatctgcttcaagctgagagacaccctgagaaagcacgacgacgcctacaagagagagatgaagatcagatga

SEQ ID NO: 9375 - RNA, 4326 nt, synthetic construct
  misc_feature 1..4326: note = derived and/or modified CDS sequence (opt4) from LACV(LAC22988-89)__U18980.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacaacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagatctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatga

SEQ ID NO: 9376 - RNA, 4326 nt, synthetic construct
  misc_feature 1..4326: note = derived and/or modified CDS sequence (opt4) from LACV(LAC30928-31)__U18979.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcaccatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaacagagacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagatctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgaccccagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9377 - RNA, 4326 nt, synthetic construct
  misc_feature 1..4326: note = derived and/or modified CDS sequence (opt4) from LACV(LAC76-40)__U70206.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaaggacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9378 - RNA, 4326 nt, synthetic construct
  misc_feature 1..4326: note = derived and/or modified CDS sequence (opt4) from LACV(LAC79-283)__U70207.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagagaatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctgggcatggccagcagaatcaacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccaccggcctgatggcccacagaaagacctacaactgcctggtgcagtacaaggccaagtggatgatgaacttcctggtgatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggacttctacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagcacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaacaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagccccagtacgccctgaagatggtgtgcaccgagagacccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatggtggccctgctggtgatcatctacgtgctgctgcccatctgcttcaagctgagagacaccctgagaaagcacgaggacgcctacaagagagagatgaagatcagatga

SEQ ID NO: 9379 - RNA, 4326 nt, synthetic construct
  misc_feature 1..4326: note = derived and/or modified CDS sequence (opt4) from LACV(LAC81-4)__U70208.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctgggcatggccagcagaatcaacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccaccggcctgatggcccacagaaagacctacaactgcctggtgcagtacaaggccaagtggatgatgaacttcctggtgatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggacttctacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagcacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagccccagtacgccctgaagatggtgtgcaccgagagacccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatggtggccctgctggtgatcatctacgtgctgctgcccatctgcttcaagctgagagacaccctgagaaagcacgaggacgcctacaagagagagatgaagatcagatga

SEQ ID NO: 9380 - RNA, 4326 nt, synthetic construct
  misc_feature 1..4326: note = derived and/or modified CDS sequence (opt4) from LACV(LACR56869)__U70205.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacatctacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatggccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggacggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcgaggtgtgcaacaccaagatcgaggccagcatggccctggtggacgccaagcccatcatcgagctggcccccgtggaccagaccacctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9381 - RNA, 4326 nt, synthetic construct
  misc_feature 1..4326: note = derived and/or modified CDS sequence (opt4) from LACV(NAT_Crawford_WI_2007)__GU596383.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccaccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccaggccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggacttctacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagagacccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9382 - RNA, 4326 nt, synthetic construct
  misc_feature 1..4326: note = derived and/or modified CDS sequence (opt4) from LACV(77)__DQ196119.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcgagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcaccatctacaacaagagctgcaagaagtgcaagctgtgcggcctggtgtaccaccccttcaccgagtgcggcacccactgcatctgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaacagagacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgaccagagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggaggcctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9383 - RNA, 4326 nt, synthetic construct
  misc_feature 1..4326: note = derived and/or modified CDS sequence (opt4) from LACV(LACV/00/NC-M (NC00-283))__GU206112.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgaagtacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatgaccaacttcaagtacgacaagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcaaccaggaggagctggacgccgtgaagaagagcaagtgctgggagatcgagtacagcgacgtgaagcccctgcaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccagcgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatggccctgctggtgatcatctacgtgctgctgcccatctgcttcaagctgagagacaccctgagaaagcacgaggacgcctacaagagagagatgaagatcagatga

SEQ ID NO: 9384 - RNA, 4326 nt, synthetic construct
  misc_feature 1..4326: note = derived and/or modified CDS sequence (opt4) from LACV(LACV/00/WV-M (WV00-3178))__GU206148.1__GP
  source 1..4326: mol_type = other RNA
atgatcagaatcctggtgctgatcgccatcaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcagcgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacctgacctgcatcctgaactacgccgtgagctggggcctggtgatcatcggcctgctgaccggcctgctgttcaagaagtaccagcacagattcctgaacacctacgccatgtactgcgaggagtgcgacatgtaccacgacaagagcggcctgaagagacacggcgacttcaccaacaagtgcagacagtgcacctgcggccagtacgaggacgccgccggcctgatgacccacagaaagacctacaactgcctggtgcagtacaaggccaagtggatgatgaacttcctgatcatctacatcttcctgatcctgatcaaggacagcgccatcatcgtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccaccgagtacgccatgctgagcagatactgcgactactacacccagttcagcgacaacagcagatacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcacctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaagaccagcaacctggccagaggcaaggagagcacctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagaccgagtaccccgaggtgaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccagatcggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgagagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagagacccggcaacaccctgaccatcaaggtgtgcaacaccaagatcgaggccagcatgaccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9385 - RNA, 4326 nt, synthetic construct
  misc_feature 1..4326: note = derived and/or modified CDS sequence (opt4) from LACV(LACV/03/NY-M (41030016))__GU206130.1__GP
  source 1..4326: mol_type = other RNA
atgatctacatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccgtgttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggaggtgttcgagctggaggagctgcccgacgacatgctggagatggccctgagaatcaacttctactacttcacctgcatcctgaactacgccgtgagctggagcctggtgatcatcggcctgctgaccggcctgctgttcaagagataccagcacaagttcctgaacatctacgccatgtactgcgaggagtgcgacatgtaccacgacaagagcggcctgaagagacacggcgacttcaccaacaagtgcagacagtgcacctgcggccagtacgaggacgccaccggcctgatgacccacagaaagacctacaactgcctggtgcagtacaaggccaagtggatcatgaacttcctgatcatctacatcttcctggtgctgatcaaggacagcgccatcatcgtgcaggccgccggcaccgacttcagcagctgcctggagaccgagagcatcaactggaactgcaccggccccttcctgaacctgggcaactgccagaagcagcagaagaaggagccctacaccaacatcgccgcccagctgaagggcctgagagccatcagcgtgctggacatccccatgatcaccgagatccccgacgacatcgccagcgccctgagatacatcgaggagagagaggccttccacgtgcagctgaccgccgagtacgccatgctgaccagatactgcgactactacacccagttcagcgacaacagcggctacagccagaccacctggagagtgtacctgagaagccacgacttcgaggcctgcatcatgtaccccaaccagcacttctgcagatgcgtgaagaacggcgagaagtgcagcagcagcaactgggacttcgccaacgagatgaaggactactacagcggcaagcaggccaagttcgacaaggacctgaacctggccctgaccgccctgcaccacgccttcagaggcaccagcagcgcctacatcgccgccatgctgagcaagaagagcaacgacgacctgatcacctacaccaacaagatcaagaccaagttccccggcaacgccctgctgaaggccatcatcgactacatcgcctacatgaagggcctgcccggcatggccagcttcaagcacgacgagttctgggacgagctgctgtacaagcccacccccaccaaggcccccaacctggccagaggcagagagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcaacggcgtgttccagagcagcaccgaccagagcatgtactgcctgctggacagccactgcctggaggagttcgaggccatcagccaggaggagctggacgccgtgaagaagagcaagtgctgggagatcgagtaccccgacatcaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccgtgatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaaggtggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacatcctgctgcccatctgcttcaagctgagagacaccctgagaaagcacgaggacgcctacaagagagagatgaagatcagatga

SEQ ID NO: 9386 - RNA, 4326 nt, synthetic construct
  misc_feature 1..4326: note = derived and/or modified CDS sequence (opt4) from LACV(LACV/06/NY(1)-M (06MS2900303))__GU206118.1__GP
  source 1..4326: mol_type = other RNA
atgatctacatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctggccctgctgatcttcatcctgctgagcatcctgagcaagacctacatctgctacctgctgatgcccgtgttcatccccatcgcctacgtgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggaggtgttcgagctggaggagctgcccgacgacatgctggagatggccctgagaatcaacttctactacttcacctgcatcctgaactacgccgtgagctggagcctggtgatcatcggcctgctgaccggcctgctgttcaagagataccagcacaagttcctgaacatctacgccatgtactgcgaggagtgcgacatgtaccacgacaagagcggcctgaagagacacggcgacttcaccaacaagtgcagacagtgcacctgcggccagtacgaggacgccaccggcctgatgacccacagaaagacctacaactgcctggtgcagtacaaggccaagtggatcatgaacttcctgatcatctacatcttcctggtgctgatcaaggacagcgccatcatcgtgcaggccgccggcaccgacttcagcagctgcctggagaccgagagcatcaactggaactgcaccggccccttcctgaacctgggcaactgccagaagcagcagaagaaggagccctacgccaacatcgccgcccagctgaagggcctgaaggccatcagcgtgctggacatccccatgatcaccgagatccccgacgacatcgccagcgccctgagatacatcgaggagagagaggccttccacgtgcagctgaccgccgagtacgccatgctgaccagatactgcgactactacacccagttcagcgacaacagcggctacagccagaccacctggagagtgtacctgagaagccacgacttcgaggcctgcatcatgtaccccaaccagcacttctgcagatgcgtgaagaacggcgagaagtgcagcagcagcaactgggacttcgccaacggcatgaaggactactacagcggcaagcaggccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagggcctgcccggcatggccaacttcaagcacgacgagttctgggacgagctgctgtacaagcccacccccaccaaggcccccaacctggccagaggcagagagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccctgaacggcgtgttccagagcagcaccgaccagagcatgtactgcctgctggacagccactgcctggaggagttcgaggccatcagccaggaggagctggacgccgtgaagaagagcaagtgctgggagatcgagtacagcgacatcaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccgtgatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaaggtggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtgaccctgctggtgatcatctacatcctgctgcccatctgcttcaaggtgagagacaccctgagaaagcacgaggacgcctacaagagagagatgaagatcagatga

SEQ ID NO: 9387 - RNA, 4326 nt, synthetic construct
  misc_feature 1..4326: note = derived and/or modified CDS sequence (opt4) from LACV(LACV/06/NY(2)-M (06MS350140))__GU206109.1__GP
  source 1..4326: mol_type = other RNA
atgatctacatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctggccctgctgatcttcatcctgctgagcatcctgagcaagacctacatctgctacctgctgatgcccgtgttcatccccatcgcctacgtgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggaggtgttcgagctggaggagctgcccgacgacatgctggagatggccctgagaatcaacttctactacttcacctgcatcctgaactacgccgtgagctggagcctggtgatcatcggcctgctgaccggcctgctgttcaagagataccagcacaagttcctgaacatctacgccatgtactgcgaggagtgcgacatgtaccacgacaagagcggcctgaagagacacggcgacttcaccaacaagtgcagacagtgcacctgcggccagtacgaggacgccaccggcctgatgacccacagaaagacctacaactgcctggtgcagtacaaggccaagtggatcatgaacttcctgatcatctacatcttcctggtgctgatcaaggacagcgccatcatcgtgcaggccgccggcaccgacttcagcagctgcctggagaccgagagcatcaactggaactgcaccggccccttcctgaacctgggcaactgccagaagcagcagaagaaggagccctacgccaacatcgccgcccagctgaagggcctgaaggccatcagcgtgctggacatccccatgatcaccgagatccccgacgacatcgccagcgccctgagatacatcgaggagagagaggccttccacgtgcagctgaccgccgagtacgccatgctgaccagatactgcgactactacacccagttcagcgacaacagcggctacagccagaccacctggagagtgtacctgagaagccacgacttcgaggcctgcatcatgtaccccaaccagcacttctgcagatgcgtgaagaacggcgagaagtgcagcagcagcaactgggacttcgccaacgagatgaaggactactacagcggcaagcaggccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagggcctgcccggcatggccaacttcaagcacgacgagttctgggacgagctgctgtacaagcccacccccaccaaggcccccaacctggccagaggcagagagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccctgaacggcgtgttccagagcagcaccgaccagagcatgtactgcctgctggacagccactgcctggaggagttcgaggccatcagccaggaggagctggacgccgtgaagaagagcaagtgctgggagatcgagtaccccgacatcaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccgtgatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaaggtggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtgaccctgctggtgatcatctacatcctgctgcccatctgcttcaagctgagagacaccctgagaaagcacgaggacgcctacaagagagagatgaagatcagatga

SEQ ID NO: 9388 - RNA, 4326 nt, synthetic construct
  misc_feature 1..4326: note = derived and/or modified CDS sequence (opt4) from LACV(LACV/06/NY(3)-M (06MS270036))__GU206121.1__GP
  source 1..4326: mol_type = other RNA
atgatctacatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcatccagttccacgcctgcttcaaccagcacatgagctgcgtgagattcctgcacagaaccatcctgcccggcagcatcgccaacagcatctgccagaacatcgagatcatcatcctggtgaccctggccctgctgatcttcatcctgctgagcatcctgagcaagacctacatctgctacctgctgatgcccgtgttcatccccatcgcctacgtgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggaggtgttcgagctggaggagctgcccgacgacatgctggagatggccctgagaatcaacttctactacttcacctgcatcctgaactacgccgtgagctggagcctggtgatcatcggcctgctgaccggcctgctgttcaagagataccagcacaagttcctgaacatctacgccatgtactgcgaggagtgcgacatgtaccacgacaagagcggcctgaagagacacggcgacttcaccaacaagtgcagacagtgcacctgcggccagtacgaggacgccaccggcctgatgacccacagaaagacctacaactgcctggtgcagtacaaggccaagtggatcatgaacttcctgatcatctacatcttcctggtgctgatcaaggacagcgccatcatcgtgcaggccgccggcaccgacttcagcagctgcctggagaccgagagcatcaactggaactgcaccggccccttcctgaacctgggcaactgccagaagcagcagaagaaggagccctacgccaacatcgccgcccagctgaagggcctgaaggccatcagcgtgctggacatccccatgatcaccgagatccccgacgacatcgccagcgccctgagatacatcgaggagagagaggccttccacgtgcagctgaccgccgagtacgccatgctgaccagatactgcgactactacacccagttcagcgacaacagcggctacagccagaccacctggagagtgtacctgagaagccacgacttcgaggcctgcatcatgtaccccaaccagcacttctgcagatgcgtgaagaacggcgagaagtgcagcagcagcaactgggacttcgccaacggcatgaaggactactacagcggcaagcaggccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagggcctgcccggcatggccaacttcaagcacgacgagttctgggacgagctgctgtacaagcccacccccaccaaggcccccaacctggccagaggcagagagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccctgaacggcgtgttccagagcagcaccgaccagagcatgtactgcctgctggacagccactgcctggaggagttcgaggccatcagccaggaggagctggacgccgtgaagaagagcaagtgctgggagatcgagtacagcgacatcaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccgtgatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaaggtggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtgaccctgctggtgatcatctacatcctgctgcccatctgcttcaagctgagagacaccctgagaaagcacgaggacgcctacaagagagagatgaagatcagatga

SEQ ID NO: 9389 - RNA, 4326 nt, synthetic construct
  misc_feature 1..4326: note = derived and/or modified CDS sequence (opt4) from LACV(LACV/65/OH-M (W17258))__GU206124.1__GP
  source 1..4326: mol_type = other RNA
atgatcagaatcctggtgctgatcgccgtgaccgccgccaaccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccgtgctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcgacagctactacttcacctgcatcctgaactacgccgtgagctggggcctggtgatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccaccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagaacatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggacttctacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9390 - RNA, 4326 nt, synthetic construct
  misc_feature 1..4326: note = derived and/or modified CDS sequence (opt4) from LACV(LACV/67/NY-M (67-8109))__GU206115.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcaccatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaacagagacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgaccagagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9391 - RNA, 4326 nt, synthetic construct
  misc_feature 1..4326: note = derived and/or modified CDS sequence (opt4) from LACV(LACV/74/NY-M (74-32813))__GU206142.1__GP
  source 1..4326: mol_type = other RNA
atgatcagaatgctggtgctgatcgtggtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgaagaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatgtacggcgtgatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccctgagaatcaacagctactacttcacctgcatcctgaactacgccgtgagctggggcctgatcatcgccggcctgctggtgggcctgatcttcaagaagtaccagcacagattcctgaacatctacgccatgtactgcgaggagtgcaacatgtaccacgacaagagcggcctgaagagacacggcgacttcaccaacaagtgcagacagtgcacctgcggccagtacgaggacgccaccggcctgatcacccacagaaagacctacaactgcctggtgcagtacaaggccaagtggatgatgaacttcctgatcatctacatcttcctgatcctgatcaaggacagcgccatcgtggtgcaggccaccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccagcatccccgacgacatcgccggcgccctgagatacatcgaggagaaggaggacttccacgtgcagctgaccaccgagtacgccatgctgagcaagtactgcgactactacacccagttcagcgacaacagcggctacagccagaccacctggagagtgtacctgagaagccacgacttcgaggcctgcatcctgtaccccaaccagcacttctgcaagtgcgtgaagaacggcgagaagtgcagcagcagcaactgggacttcgccaacgagatgaagaactactacagcggcaagcaggccaagttcgacaaggacctgaacctggccctgaccgccctgcaccacgccttcagaggcaccagcagcgcctacatcgccgccatgctgagcaagaagagcaacgacgacctgatcgcctacaccaacaagatcaaggccaagttccccggcaacgccctgctgaaggccatcatcgactacatcgcctacatgaagggcctgcccgagatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacagcagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgagacccctgcaggagagcgacggcgccaagagctgcagaatgaaggacagcggcaactgcaacgtggccaccaacagatggcccgtgatgcagtgcgagaacgacaagttctactacagcgagctgcagaaggactacgacaagacccaggacatcggccactactgcctgagccccggctgcaccaccatcagataccccatcaaccccaagcacatcagcaactgcaactggcaggtgagcagaagcagcatcgccaagatcgacgtgcacaacgtggaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcgtgggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccaacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcgccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccagaatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcatcgccctgctggtgatcatctacgtgctgctgcccatctgcttcaagctgagagacaccctgagaaagcacgacgacgcctacaagagagagatgaagatcagatga

SEQ ID NO: 9392 - RNA, 4326 nt, synthetic construct
  misc_feature 1..4326: note = derived and/or modified CDS sequence (opt4) from LACV(LACV/93/MO-H)__GU206139.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacatctacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactggggcttcgccaacgagatgaaggactactacagcggcaagcagaccaagttcgacaaggacctgaacctggccctgaccgccctgcaccacgccttcagaggcaccagcagcgcctacatggccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgacaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggacggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaaggtggtgtgcaccgagaagcccggcaacaccctgaccatcgaggtgtgcaacaccaagatcgaggccagcatggccctggtggacgccaagcccatcatcgagctggcccccgtggaccagaccacctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9393 - RNA, 4326 nt, synthetic construct
  misc_feature 1..4326: note = derived and/or modified CDS sequence (opt4) from LACV(LACV/95/OH-H (CCH-MB96))__GU206136.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatgatcaccgccgtgctggtgctgaccttcgtgacccccatcaacagcatggtgctgggcgagagcaaggagaccttcgagctggaggagctgcccgacgacatgctggagatggtgagcagaatcaacagctactacttcacctgcatcctgaactacgccgtgagctggggcctgatcatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactggggcttcgccaacgagatgaaggacttctacagcggcaagcagaccaagttcgacaaggacctgaacctggccctgaccgccctgcaccacgccttcagaggcaccagcagcgcctacatcgccaccgtgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccagcggccccagcgtgtacagaaagccccccggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcagaggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9394 - RNA, 4326 nt, synthetic construct
  misc_feature 1..4326: note = derived and/or modified CDS sequence (opt4) from LACV(LACV/95/WV-H)__GU206133.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcaccatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgaccagagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9395 - RNA, 4326 nt, synthetic construct
  misc_feature 1..4326: note = derived and/or modified CDS sequence (opt4) from LACV(LACV/96/WV-M (WV96-3955))__GU206145.1__GP
  source 1..4326: mol_type = other RNA
atgatctacatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcaccggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggaggtgttcgagctggaggagctgcccgacgacatgctggagatggccctgagaatcaacagctactacttcacctgcatcctgaactacgccgtgagctggggcctgatcatcatcggcctgctgaccggcctgctgttcaagaagtaccagcacagattcctgaacatctacgccatgtactgcgaggagtgcgacatgtaccacgacaagagcggcctgaagagacacggcgacttcaccaacaagtgcagacagtgcacctgcggccagtacgaggacgccgccggcctgatgacccacagaaagacctacaactgcctggtgcagtacaaggccaagtggatcatgaacttcctgatcgtgtacatcttcctgatcctgatcaaggacagcgccatcatcgtgagagccgccggcaccgacttcagcagctgcctggagaccgagatcatcaactggaactgcaccggccccttcctgaacctgggcaactgccagagacagcagaagaaggagccctacgccaacatcgccgcccagctgaagggcctgaaggccatcagcgtgctggacatccccatgatcaccgagatccccgacgacatcgccagcgccctgagatacatcgaggagagagaggccttccacgtgcagctgaccgccgagtacgccatgctgagcagatactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcgccaactgggacttcgccaacgagatgaaggactactacagcggcaagcaggccaagttcgacaaggacctgaacctggccctgaccgccatgcaccacgccttcagaggcaccagcagcgcctacatggccgccatgctgagcaagaagagcaacgacgacctgatcacctacaccaacaagctgaagaccaagttccccggcaacgccctgctgaaggccatcatcgactacatcgcctacatgaagggcctgcccggcatggccaacttcaagcacgacgagttctgggacgagctgctgtacaagcccacccccaccaaggcccccaacctggccagaggcagagagagcagctacaacttcgagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgaccagagcatgtactgcctgctggacagccactgcctggaggagttcgaggccatcagccaggaggagctggacgccgtgaagaagagcaagtgctgggagatcgagtaccccgacgtgaagctgctgcaggagaacgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcgccaccatcagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcgtgaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacaacgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaaggtggtgtgcaccgagaagcccggcaacaccctgaccatcaaggtgtgcaacaccaagatcgaggccgccatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacatcctgctgcccatctgcttcaagctgagagacaccctgagaaagcacgaggacgcctacaagagagagatgaagatcagatga

SEQ ID NO: 9396 - RNA, 4326 nt, synthetic construct
  misc_feature 1..4326: note = derived and/or modified CDS sequence (opt4) from LACV(LACV/97/NC-M (NC97-7306))__GU206127.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacatcagaaacgccaccggcgtgttcagcaacaacgtggccatcagaaagtggctggtgagcgactggcacgactgcagacccaagaagatcatcggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacgtgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatgatcaccgccgtgctggtgctgaccttcgtgacccccatcaacagcatggtgctgggcgagagcaaggagaccttcgagctggaggagctgcccgacgacatgctggagatggtgagcagaatcaacagctactacttcacctgcatcctgaactacgccgtgagctggggcctgatcatcatcggcctgctgaccggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacatccccatcatcaccggcatccccgacgacatcgccggcgccctgagatacatcgaggagagagaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggacttctacagcggcaagcagaccaagttcgacaaggacctgaacctggccctgaccgccctgcaccacgccttcagaggcaccagcagcgtgtacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagccccccggcggcgtgttccagagcagcaccgacagaagcatctactgcctgctggacagccactgcctggaggagttcgaggccatcagccaggaggagctggacgccgtgaagaagagcaagtgctgggagatcgagtaccccgacgtgaagcccctgcaggagagcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaaggcctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagagacccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9397 - RNA, 4326 nt, synthetic construct
  misc_feature 1..4326: note = derived and/or modified CDS sequence (opt4) from LACV(LACV/human/1960)__EF485031.1__GP
  source 1..4326: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcaccatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagggccacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcgacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgaccagagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggtgatcatctacgtgctgctgcccatctgcttcaagctgagagacaccctgagaaagcacgaggacgcctacaagagagagatgaagatcagatga

SEQ ID NO: 9398 - RNA, 4326 nt, synthetic construct
  misc_feature 1..4326: note = derived and/or modified CDS sequence (opt4) from LACV(LACV/mosquito/1978)__EF485037.1__GP
  source 1..4326: mol_type = other RNA
atgatcagaatcctggtgctgatcgccgtgaccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcatcggcggccacatcaacgtgatcgaggtgagcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatgtacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggagctgcccgacgacatgctggagatggccagcagaatcaacagctactacttcacctgcatcctgaactacgccgtgagctggggcctggtgatcatcggcctgctgaccggcctgctgttcaagaagtaccagcacagattcctgaacatctacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcgactggaactgcaccggccccttcctgaacctgggcaactgccagaagcagcagaagaaggagccctacaccaacatcgccacccagctgaagggcctgaaggccatcagcgtgctggacatccccatcatcaccagaatccccgacgacatcgccggcgccctgagatacatcgaggagagagaggacttccacgtgcagctgaccaccgagtacgccatgctgagcaagtactgcgactactacacccagttcagcgacaacagcggctacagccagaccacctggagagtgtacctgagaagccacgacttcgaggcctgcatcctgtaccccaaccagaacttctgcagatgcgtgaagaacggcgagaagtgcagcagcagcaactgggacttcgccaacgagatgaaggactactaccccggcaagcaggccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcagccaggaggagctggacgccgtgaagaagagcaagtgctgggagatcgagtacagcgacgtgaagcccctgcaggagggcaacggcaccaagagctgcagaatgaaggacagcggcaactgcaacgtggccaccaacagatggcccgtgatccagtgcgagaacgacaagttctactacagcgagctgcagaaggactacgacaagacccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacgccaagctgtacagcaccggccccaccagcggcatcaacaccaagcacgacgagctgtgcaccggcccctgccccgccaacatcaaccaccaggtgggctggctgaccttcgccaaggagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccgtgtacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaagatcgaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggccctgctggccatcatctacgtgctgctgcccatctgcttcaagctgagagacaccctgagaaagcacgaggacgcctacaagagagagatgaagatcagatga

SEQ ID NO: 9399 - RNA, 4326 nt, synthetic construct; identical to SEQ ID NO: 9368
  misc_feature 1..4326: note = derived and/or modified CDS sequence (opt4) from LACV__KP271111.1__GP
  source 1..4326: mol_type = other RNA

SEQ ID NO: 9400 - RNA, 4263 nt, synthetic construct
  misc_feature 1..4263: note = derived and/or modified CDS sequence (opt4) from OROV(BeAn19992)__NC_005775.1__GP
  source 1..4263: mol_type = other RNA
atggccaacctgatcatcatcagcatggtgctgggcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacaagcccgccctggaggccaccaccaagttctacagaagcttcatcgtgaaggactggagcgagtgcaaccccgtgctggacaagttcggcaacttcatggtgctgagcgtggacgacaacggccacatcatccccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagttctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagaatcttctacagaagctgcagcatgtgcggcctgatccactacagacccggcctgaagatcgacctgaccaagaccaacagatgcggcagctgcatctgcggcttcgacgagcagcagagcagcggcttcgagtacgagatcttcctgaaggacatgcacgtgcagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcgacacctgcgtgagcaagagcgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaacaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacctgaacatcaaggagtgcatgagccccgagagcctgaagtgcttcaagaagagaggcagcaccccccacaccaaccacctgctgtgcaagatcgacaacaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcaggccggcatcaagaagtgcagcgccgacgagatcggcgagtgcaccaccctggaggacaagacctggcccatcatcttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttccagagcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacatcaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcaccgcccacatctgcggcagagacatcgacctgcagctgaccatcaagccctacaaccagaagatcgacctgagccagctggacgagagcaactacatcagagaggaggacctgcagtgcggcacctggctgtgcaaggtgcagaaggagggcatcgacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9401 - RNA, 4263 nt, synthetic construct
  misc_feature 1..4263: note = derived and/or modified CDS sequence (opt4) from OROV(BeH759021)__KP691607.1__GP
  source 1..4263: mol_type = other RNA
atggccaacctgatcatcatcagcatggtgctgagcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacagacccgccctggaggccaccaccaagttctacagaagcttcatcgtgaaggactggagcgagtgcaaccccgtgctggacaagttcggcaacttcatggtgctgagcgtggacgacaacggccacatcatgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagcatcttctacagaagctgcagcatgtgcggcctgatccactacagacccggcctgaagatcgacctgaccaagaccaacaagtgcggcagctgcatctgcggcttcaacgagcagcagagcagcggcttcgagtacgagatcttcctgaaggacatgcacatccagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcaacacctgcgtgagcaagaacgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacagcaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcaccaccctggaggacaagacctggcccatcgtgttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcagcgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacgtgaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcatcgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcgtggacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9402 - RNA, 4263 nt, synthetic construct
  misc_feature 1..4263: note = derived and/or modified CDS sequence (opt4) from OROV(BeH759022)__KP691610.1__GP
  source 1..4263: mol_type = other RNA
atggccaacctgatcatcatcagcatggccctgagcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacagacccgccctggaggccaccaccaagttctacagaagcttcatcgtgaaggactggagcgagtgcaaccccgtgctggacaagttcggcaacttcatggtgctgagcgtggacgacaacggccacatcatgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagcatcttctacagaagctgcagcatgtgcggcctgatccactacagacccggcctgaagatcgacctgaccaagaccaacaagtgcggcagctgcatctgcggcttcaacgagcagcagagcagcggcttcgagtacgagatcttcctgaaggacatgcacatccagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcaacacctgcgtgagcaagaacgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacagcaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcaccaccctggaggacaagacctggcccatcgtgttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcagcgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacgtgaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcatcgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcgtggacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9403 - RNA, 4263 nt, synthetic construct
  misc_feature 1..4263: note = derived and/or modified CDS sequence (opt4) from OROV(BeH759040)__KP691616.1__GP
  source 1..4263: mol_type = other RNA
atggccaacctgatcatcatcagcatgatcctgagcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacagacccgccctggaggccaccaccaagttctacagaagcttcatcgtgaaggactggagcgagtgcaaccccgtgctggacaagttcggcaacttcatggtgctgagcgtggacgacaacggccacatcatgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagcatcttctacagaagctgcagcatgtgcggcctgatccactacagacccggcctgaagatcgacctgaccaagaccaacaagtgcggcagctgcatctgcggcttcaacgagcagcagagcagcggcttcgagtacgagatcttcctgaaggacatgcacatccagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcaacacctgcgtgagcaagaacgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacagcaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcaccaccctggaggacaagacctggcccatcgtgttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcagcgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacgtgaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcatcgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcgtggacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9404 - RNA, 4263 nt, synthetic construct
  misc_feature 1..4263: note = derived and/or modified CDS sequence (opt4) from OROV(BeH759146)__KP691631.1__GP
  source 1..4263: mol_type = other RNA
atggccaacctgatcatcatcagcatggtgctgagcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacagacccgccctggaggccaccaccaagttctacagaagcttcatcgtgaaggactggagcgagtgcaaccccgtgctggacaagttcggcaacttcatggtgctgagcgtggacgacaacggccacatcatgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgctgccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagcatcttctacagaagctgcagcatgtgcggcctgatccactacagacccggcctgaagatcgacctgaccaagaccaacaagtgcggcagctgcatctgcggcttcaacgagcagcagagcagcggcttcgagtacgagatcttcctgaaggacatgcacatccagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcaacacctgcgtgagcaagaacgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacatcatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacagcaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcaccaccctggaggacaagacctggcccatcgtgttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcagcgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacgtgtgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacgtgaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcatcgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcgtggacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9405 - RNA, 4263 nt, synthetic construct
  misc_feature 1..4263: note = derived and/or modified CDS sequence (opt4) from OROV(BeH759620)__KP691622.1__GP
  source 1..4263: mol_type = other RNA
atggccaacctgatcatcatcagcatggtgctgagcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacagacccgccctggaggccaccaccaagttctacagaagcttcatcgtgaaggactggagcgagtgcaaccccgtgctggacaagttcggcaacttcatggtgctgagcgtggacgacaacggccacatcatgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcatcaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagcatcttctacagaagctgcagcatgtgcggcctgatccactacagacccggcctgaagatcgacctgaccaagaccaacaagtgcggcagctgcatctgcggcttcaacgagcagcagagcagcggcttcgagtacgagatcttcctgaaggacatgcacatccagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcaacacctgcgtgagcaagaacgagctgtacagcgacctgttcagcaagaacctggtgaccgagtacgacaagaagtacttcgagcccgacaccgtgaacgaccagttcaacaagatcgagttcgcccaggacagccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacagcaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcaccaccctggaggacaagacctggcccatcgtgttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcagcgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacgtgaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcatcgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcgtggacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9406 - RNA, 4263 nt, synthetic construct
  misc_feature 1..4263: note = derived and/or modified CDS sequence (opt4) from OROV(BeAn19991)__KP052851.1__GP
  source 1..4263: mol_type = other RNA
atggccaacctgatcatcatcagcatggtgctgggcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacaagcccgccctggaggccaccaccaagttctacagaagcttcatcgtgaaggactggagcgagtgcaaccccgtgctggacaagttcggcaacttcatggtgctgagcgtggacgacaacggccacatcatccccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagaatcttctacagaagctgcagcatgtgcggcctgatccactacagacccggcctgaagatcgacctgaccaagaccaacagatgcggcagctgcatctgcggcttcgacgagcagcagagcagcggcttcgagtacgagatcttcctgaaggacatgcacgtgcagaaggagagctgcaagttcagccccagagtgaaccacttcagaaacatcaaggccctgctgttcgccctggtgatctgcgccaccatctacaccgtgtacgccgacgaggactgcctgagcaaggacatcaagatcacctaccaggagctgcacaactgcatcggccccaagatcatgggcgacacctgcgtgagcaagagcgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacttcaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacctgaacatcaaggagtgcatgagccccgagagcctgaagtgcttcaagaagagagacagcaccccccacaccaaccacctgctgtgcaagatcgacaacaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcaggccggcatcaagaagtgcagcgccgacgagatcggcgagtgcaccaccctggaggacaagacctggcccatcatcttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacatcaactacaagatcttcaccaagagcatcgacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcaccgcccacatctgcggcagagacatcgacctgcagctgaccatcaagccctacaaccagaagatcgacctgagccagctggacgagagcaactacatcagagaggaggacctgcagtgcggcacctggctgtgcaaggtgcagaaggagggcatcgacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9407 - RNA, 4263 nt, synthetic construct
  misc_feature 1..4263: note = derived and/or modified CDS sequence (opt4) from OROV(Tr9760)__AF312381.2__GP
  source 1..4263: mol_type = other RNA
atggccaacctgatcatcatcagcatggtgctgagcatcgcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacaagctggccctggaggccaccaccaagttctacagaagcttcatcgtgaaggactggagcgagtgcaaccccgtgctggacaagttcggcaacttcatggtgctgagcgtggacgacaacggccacaccatccccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcgtgagattcttcaagggcacctacatgccccacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgccacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagaatcttctacagaagctgcagcatgtgcggcctgatccactacagacccggcctgaagatcgacctgaccaagaccaacagatgcggcagctgcatctgcggcttcgacgagcagcagagcagcggcttcgagtacgagatcttcctgaccgacatgcacgtgcagaaggagagctgcaagttcagccccagagtgaaccacttcagaaacaccaaggccctgctgttcgccctggtgatctgcgccaccatctacaccgtgtacgccgacgaggactgcctgagcaaggacatcaagatcacctaccaggagctgcacaactgcatcggccccaagatcatgggcgacacctgcgtgagcaagagcgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacccacctgaagaaccacaacatcgacctgtgcagcagacacaactacaagatgatctgccagtgcatcaacgcccacagcatgtgcaagaacaccgacatcgactacaacaaggagatcgagacctactacaagagcaacgccgccgcctacagagccggcctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacaacaagtacaaggccttcgactggcccgagatcgagaccatccagaagggccagaagctgtgcctgggcgacagccactgcaacctggagttcaccgccatcaccgccgacagaatcatgagcctgaccaactgctacaaggagagcttcaccgcccagcccgccgacatgcaggccggcatcaagaagtgcagcgccgacgagatcggcgagtgcaccaccctggaggacaagacctggcccatcgtgttctgcagcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagaccctacgagaccaacaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctggacgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcaccgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcatcgacatcatgttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9408 - RNA, 4263 nt, synthetic construct
  misc_feature 1..4263: note = derived and/or modified CDS sequence (opt4) from OROV(TRVL-9760)__KC759123.1__GP
  source 1..4263: mol_type = other RNA
atggccaacctgatcatcatcagcatggtgctgagcatcgcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgtgttcagcaagaacaagctggccctggaggccaccaccaagttctacagaagcttcatcgtgaaggactggagcgagtgcaaccccgtgctggacaagttcggcaacttcatggtgctgagcgtggacgacaacggccacatcatccccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgccacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgccgagttcatcaagctgaccgagcaggtgaacatcctggagagagagatggaggtgctgaagcagagcatcatcgtgatgttcgccatcatcctggtgctgctgctgttcgagaacatgatcttcaacagactgttcagaatcttctacagaagctgcagcatgtgcggcctgatccactacagacccggcctgaagatcgacctgaccaagaccaacagatgcggcagctgcatctgcggcttcgacgagcagcagagcagcggcttcgagtacgagatcttcctgaaggacatgcacgtgcagaaggagagctgcaagttcagccccagagtgaaccacttcagaaacaccaaggccctgctgttcgccctggtgatctgcgccaccatctacaccgtgtacgccgacgaggactgcctgagcaaggacatcaagatcacctaccaggagctgcacaactgcatcggccccaagatcatgggcgacacctgcgtgagcaagagcgagctgtacagcgacctgttcagcaagaacctggtgaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacgcccacagcatgtgcaagaacaccgacatcgactacaacaaggagatcgagacctactacaagagcaacgccgccgcctacagagccgacctgaacaccatcatggacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacaacaagtacaaggccttcgactggcccgagatcgagaccatccagaagggccagaagctgtgcctgggcgacagccactgcaacctggagttcaccgccatcaccgccgacagaatcatgagcctgaccaactgctacaaggagagcttcaccgcccagcccgccgacatgcaggccggcatcaagaagtgcagcgccgacgagatcggcgagtgcaccaccctggaggacaagacctggcccatcgtgttctgcagcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgaggtgcccgccgagaccgtgtgccactgcaagaccaactgcgaggacttcatcaacaacatcgtgttcagcccccagatcaagaactacaacatcaaggtgcactgcaagagcaaggtggagaagatcaccgcccacatctgcggcagagacatcgacctgcagctgaccgtgaagccctacaaccagaagatcgacctgagccagctggacgagagcaactacatcagagaggaggacctgcagtgcggcacctggctgtgcaaggtgcagaaggagggcatcgacatcatgttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9409 - RNA, 4263 nt, synthetic construct
  misc_feature 1..4263: note = derived and/or modified CDS sequence (opt4) from OROV(TVP-19244/DEI-216)__KP795073.1__GP
  source 1..4263: mol_type = other RNA
atggccaacctgatcatcatcagcatgatcctgggcatcgcctacggccaccccctgagcaccagccagatcggcgacagatgcttcgccggcggcatcctgttcaaggagatgaacctgagcgtgggcctgggcgagatctgcgtgaaggacgacatcagcatcgtgaagagcaccaccgccttcagcaagaacgccctggccctggaggccaccaccaagttctacagaagcttcatcgtgaaggactggagcgagtgcaaccccgtgctggacaagttcggcaacttcatggtgctgaacgtggacgacaacggccacctggtgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacatcgcctacctgctgctgcccctgttctaccccgtgacctggctgtacggcaaggtgtacaagagaatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagctgaccgagcaggtgaacatcctgggcaaggagatcaagatcctgaagcagagcatcatcgtgatgctggccatcatcctgatcctgctgctgagcgagaacatcatcttcaactacctgttcagcaccctgtacagaagctgcagcatgtgcggcctgatccactacagacccggcctgaaggtggacagcaccaagaccaacaagtgcggcagctgcatctgcggcttcgacgagcagcagagcagcggcttcgagtacgaggtgttcctgaaggacatgcacgtgcagagagagagctgcaagttcggccccagagtgaaccacttcagaaacaccaagatcctgctgttcaccgtggccatctgcaccagcttctacaccgtgtacgccgacgaggactgcctgagcaagaacatcagaatcacctaccaggagctgcacaactgcatcggcccccacatcatgggcgacacctgcatgagcaagagcgagctgtacagcgacctgctgagcaagaacctgatcaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgacttcaacaaggagatcgagacctactacaaggccaacgccgccgcctacagaagcgacttcaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatggtgggcgtgctgaagttcgccagcaagctgctgaacatcagcctgggcagaaccaccagaagcgcccagcacagcatcatgaccaacgagatccccaagagcaaccccttcaccgactacagctacagcagcgtgaacatcaaggagtgcatgagccccgagagcctgaagtgcttcaagaagagagacagcgccccccacatgaaccacctgctgtgcaagatggacaacaagtacaaggccttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcatcaccctggaggacaagagctggcccatcgtgttctgcggcgacaagtactactacagcgacggcaaggagcacgccaaggacggcagcatcaacaactactgcctggccaacaagtgcagcgagcagagattccccatccacaagaactggttcaagaagtgcaactgggacaagacccacaaggagttcaccaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcaagggcaaccagctgttcgacatcgtgatcttcgtgaagaaggccgtgtacaaggcccagtaccagaaggtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaacctgatggcctacaagaagggcaaggtgtacaccggccagatcaacgacgtgggcaacaccgccctgcagtgcggcagcatccaggtggtgaacggcagcaccatcggcagcggcaaccccaagttcgactacatctgccacgccatgagaagaaaggacgtgatcgtgagaaagtgcttcaacgacaactaccagagctgcaccagactgaaccccagaaacgacctgatcccctacagaaagggcgacatcatcgagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgtgagcgccgagaccgtgtgccactgcaagaccaactgcgaggacttcatcagcaacatcgtgatcagcccccagatcaagacctacaacatcaaggtgcactgcaagagcaaggtgaagaagatcaccgccaacatctgcggcagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactgggccatcctgatctacagcatcatcggcatcatcgtggtgatcctgctgatctacgtgctgctgcccatcggcagactgctgaaggccttcctgatcaagaacgagatcgagtacaccatggagcagaagatcaagtga

SEQ ID NO: 9410 - RNA, 4263 nt, synthetic construct
  misc_feature 1..4263: note = derived and/or modified CDS sequence (opt4) from OROV(TVP-19249/GML-444672)__KP795076.1__GP
  source 1..4263: mol_type = other RNA
atggccaacctgatcatcttcagcatcatcctgggcatcgcctacggccaccccctgagcaccagccagatcggcgacagatgcttcgccggcggcagcctgttcaaggagatgaacctgagcgtgggcctgggcgagatctgcgtgaaggacgacatcagcatcgtgaagagcaccaccgccttcagcaagaacaccctggccctggaggccaccaccaagttctacagaagcttcatcgtgaaggactggagcgagtgcaaccccgtgctggacaagctgggcaacttcatggtgctgaacgtggacgacaacggccacctggtgcccagaatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcatcaacatcgagctgatcatcctgaccctgtacatcttcgccgccatcatcttcgccctgatcatcaccaagagctacatcgcctacctgctgctgcccctgttctaccccgtgacctggctgtacggcaaggtgtacaagagaatcaacagctgcagcaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagatggccgagagagtgggcatgctggagaaggagatcaaggtgctgaagcagttcaccatcgtgatgctggtgatcatcctgatcctgctgctgttcgagaacaccatcttcaactacctgttcaacaccctgtacagaagctgcagcatgtgcggcctgatccactacagacccggcctgaaggtggacctgaccaagaccaacaagtgcggcagctgcatctgcggcttcgacgagcagcagagcagcggcttcgagtacgaggtgttcctgaaggacatgcacatccagagagagagctgcaagttcggccccagagtgaaccacttcagaaacaccaagatcctgctgttcaccatcgccatctgcaccagcttctacaccgtgtacgccgacgaggactgcctgagcaagaacatcaagatcacctaccaggagctgcacaactgcatcggcccctacatcatgggcgacacctgcgtgagcaagagcgagctgtacagcgacctgctgagcaagaacctgatcaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacatgcacagcatgtgcaagaacaccgacatcgacttcaacaacgagatcgagacctactacaaggccaacgccgccgcctacagaagcgacttctacaccatcatcgacaccctgaagaccgccttcagaggcctgaccaaggtgctgatcgagaactacatcgagaaggacgacagcgacgccctgaaggccctgttcagcaacatcaccaacagcgtgcaggacaactaccagatggtgggcgtgctgaagttcgccagcaagctgctgaacatcagcctgggcagaagcaccagaagcgcccagcacagcatcatgaccaacgagatccccaagagcaaccccttcaccgactacagctacagcagcgtgaacatcaaggagtgcatgagccccgagagcctgaagtgcttcaagaagagagacagcgtgccccacaccaaccacctgctgtgcaagatggacaacaagtacaaggccttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcatcaccctggaggacaaggcctggcccatcgtggtgtgcggcgacaagtactactacagcgacggcaaggagcacgccaaggacggcagcatcaacaactactgcctggccaacaagtgcagcgagcagagattccccatccacaagaactggttcaagaagtgcaactgggacaagacccacaaggagttcaccaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcagaggcaaccagctgttcgacatcgtgatcttcgtgaagaaggccgtgtacaaggcccagtaccagaaggtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccgtgctgatggcctacaagaagggcaaggtgtacaccggccagatcaacgacgtgggcaacaccgccctgcagtgcggcagcatccaggtggtgaacggcagcaccatcggcagcggcaaccccaagttcgactacatctgccacgccatgagaagaaaggacgtgatcgtgagaaagtgcttcaacgacaactaccagagctgcaccagactggacgccagaaacgacctgatcccctacagaaagggcgacatcatcgagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgtgagcgccgagaccgtgtgccactgcaagaccaactgcgaggacttcatcagcaacatcgtgatcagcccccagatcaagacctacaacatcaaggtgcactgcaagagcaaggtggagaagatcaccgccaacatctgcggcagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactggaccatcctgatctacagcatcatcggcatcatcgtgatcgtgctgctgatctacgtgctgctgcccatcggcagactgctgaaggccttcctgatcaagaacgagatcgagtacaccatggagcagaagatcaagtga

SEQ ID NO: 9411 - RNA, 4263 nt, synthetic construct
  misc_feature 1..4263: note = derived and/or modified CDS sequence (opt4) from OROV(TVP-19254/GML-480914)__KP795082.1__GP
  source 1..4263: mol_type = other RNA
atggccaacctgatcatcatcagcatggtgctgagcgtggcctacggccaccccctgagcaccagccagatcggcgacagatgcttcgccggcggcaacctgttcaaggagatgaacctgagcgtgggcctgggcgagatctgcgtgaaggacgacatcagcatcgtgaagagcaccaccgccttcagcaagaacaagcccgccctggaggccaccaccaagttctacagaagcttcatcgtgaaggactggagcgagtgcaaccccgtgctggacaagttcggcaacttcatggtgctgagcgtggacgacaacggccacatcatccccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacgtggcctacctgctgctgcccctgttctaccccgtgacctggttctacggcaaggtgtacaagaagatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcatcagccccatcgccggcgagagaatgtacaagctggaggagctggccgacgagttcatcaagctgaccgagcaggtgaacatcctggagagagagatggaggtgctgaagcagagcgtgatcgtgatgctggccatcatcctggtgctgctgctgttcgagaacatgatcttcaacagactgttcagaatcttctacagaagctgcagcatgtgcggcctgatccactacagacccggcctgaagatcgacctgaccaagaccaacagatgcggcagctgcatctgcggcttcgacgagcagcagagcagcggcttcgagtacgagatcttcctgaaggacatgcacatccagaaggagagctgcaagttcagccccagagtgaaccacttcagaaacatcaaggccctgctgttcgccctggtgatctgcgccaccatctacaccgtgtacgccgacgaggactgcctgagcaagaacatcaagatcacctaccaggagctgcacaactgcatcggccccaagatcatgggcgacacctgcgtgagcaagagcgagctgtacagcgacctgttcagcaagaacctggtgaccgagtacgacaagaagtacttcgagcccgacaccatcaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgactacaacaaggagatcgagacctactacaagagcaacgccgccgcctacagagccgacctgaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatgatcggcatcctgaagttcgccagcaagctgctggacatcaacctgggcagaagcaccagaagcgcccaccacagcatcatgaccaacgagatccccaagagcaaccccttcaccgactacagctacagcaacgtgaacatcaaggagtgcatgagccccgagagcctgaagtgcttcaagaagagagacagcaccccccacaccaaccacctgctgtgcaagatcgacaacaagtacaaggccttcgactggcccgagatcgagaccatccagaagggccagaagctgtgcctgggcgacagccactgcaacctggagttcaccgccatcaccgccgacaagatcatgagcctgaccaactgctacaaggagagcttcaccgcccagcccgccgacatgcaggccggcatcaagaagtgcagcgccgacgagatcggcgagtgcaccaccctggaggacaagacctggcccatcgtgttctgcggcggcaagtactactacagcgacagcaaggagcacgccaaggacggcagcatcaacaactactgcctgaccaacaagtgcagcgagcagagattccccatccacgagaactggttcaagaagtgcaactgggacaagacccacaaggagttcagcaccatgaagcagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcctgatcaacggcttcatccagaacaccatccccgccatcagcggcctgggcgtgggctaccacctgaacttcaagggcaaccagctgttcgacatcgtgatcttcgtgaagaaggccgtgtacaaggcccagtaccagaaggcctacaccaccggccccagcatcagcatcaacatcgagcacaacgagagatgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacgtgtacaagaagatcggcagcgaggtgagcctgatcgagatctgcatcaccctgccccacgagacctactgcaacgacatggacatcctggagcccatcatcggcgacaagctgagcgccagcttccagaacacccagaccaaccagctgcccaccctgatcgcctacaagaagggcaagatctacaccggccagatcaacgacatcggcaacaccgccctgcagtgcggcagcatccaggtgatcaacggcagcaccatcggcaccggcagccccaagttcgactacatctgccacgccatgagaagaaaggacgtgatcgtgagaaagtgcttcaacgacaactaccagagctgcaccagactggagaagagaaacgacctgatcccctacagaaagggcgacgtgatcgaggtgagcaagaccggcagcaacatgggccagatgaccttcaagatcgagctgggcgacatcaactacaagatcttcaccaagagcatcgacctgcagatgagcggcatctgcgccggctgcatcgactgcgccgagggcatcagctgcagcatcaacgccgaggtgagcgccgagaccgtgtgccactgcaagaccaactgcgaggacttcatcaacaacatcgtgttcagcccccagatcaagaactacaacatcaaggtgcactgcaagagcaaggtggagaagatcatcgcccacatctgcggcaaggacatcgacctgcagctgaccgtgaagccctacaaccagaagatcgacctgagccagctggacgagagcaactacatcagagaggaggacctgcagtgcggcacctggctgtgcaaggtgcagaaggagggcatcgacatcatcttcaagggcctgttcagcggcctgggcagatactggaccatcctgatctacagcatcatcggcgtggtgatcatcgtgatcctggtgtacatcctgctgcccatcggcagactgctgaaggccttcctgatcagacacgagatcgagtacgccatggagcagaagatcaagtga

SEQ ID NO: 9412 - RNA, 4263 nt, synthetic construct
  misc_feature 1..4263: note = derived and/or modified CDS sequence (opt4) from OROV(TVP-19256/IQE-7894)__KP795085.1__GP
  source 1..4263: mol_type = other RNA
atggccaacctgatcatcatcagcatgatcctgggcatcgcctacggccaccccctgagcaccagccagatcggcgacagatgcttcgccggcggcagcctgttcaaggagatgaacctgagcgtgggcctgggcgagatctgcgtgaaggacgacatcagcatcgtgaagagcaccaccgccttcagcaagaacgccctggccctggaggccaccaccaagttctacagaagcttcatcgtgaaggactggagcgagtgcaaccccgtgctggacaagttcggcaacttcatggtgctgaacgtggacgacaacggccacctggtgcccaagatgtacacctgcagagccgcctgcgacatcagactgaacaaggacaacgccgaggtgatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcgcctacatgccctacagcatgatcgaggccatgtgcgtgaacatcgagctgatcatcctgaccctgtacatcttcgccgccatcatcttcgccctgatcatcaccaagagctacatcgcctacctgctgctgcccctgttctaccccgtgacctggctgtacggcaaggtgtacaagagaatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagctggccgagcaggtgaacatcctgggcaaggagatcaagatcctgaagcagagcatcatcgtgatgctggccatcatcctgatcctgctgctgagcgagaacatcatcttcaactacctgttcaagaccctgtacagaagctgcagcatgtgcggcctgatccactacagacccggcctgaaggtggacctgaccaagaccaacaagtgcggcagctgcatctgcggcttcgacgagcagcagagcagcggcttcgagtacgaggtgttcctgaaggacatgcacgtgcagagagagagctgcaagttcggccccagagtgaaccacttcagaaacaccaagatcctgctgttcaccatcgccatctgcaccagcttctacaccgtgtacgccgacgaggactgcctgagcaagaacatcagaatcacctaccaggagctgcacaactgcatcggcccccacatcatgggcgacacctgcatgagcaagagcgagctgtacagcgacctgctgagcaagaacctgatcaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgacttcaacaaggagatcgagacctactacaaggccaacgccgccgcctacagaagcgacttcaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatggtgggcgtgctgaagttcgccagcaagctgctgaacatcagcctgggcagaaccaccagaagcgcccagcacagcatcatgaccaacgagatccccaagagcaaccccttcaccgactacagctacagcagcgtgaacatcaaggagtgcatgagccccgagagcctgaagtgcttcaagaagagagacagcgtgccccacaccaaccacctgctgtgcaagatggacaacaagtacaaggtgttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcatcaccctggaggacaagagctggcccatcgtgttctgcggcgacaagtactactacagcgagggcaaggagcacgccaaggacggcagcatcaacaactactgcctggccaacaagtgcagcgagcagagattccccatccacaagaactggctgaagaagtgcaactgggacaagacccacaaggagttcaccaccatgagaagaatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcaagggcaaccagctgttcgacatcgtgatcttcgtgaagaaggccgtgtacaaggcccagtaccagaaggtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaacctgatggcctacaagaagggcaaggtgtacaccggccagatcaacgacgtgggcaacaccgccctgcagtgcggcagcatccaggtggtgaacggcagcaccatcggcagcggcaaccccaagttcgactacatctgccacgccatgagaagaaaggacgtgatcgtgagaaagtgcttcaacgacaactaccagagctgcaccagactggaccccagaaacgacctgatcccctacagaaagggcgacatcgtggagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgccagcgccgagaccgtgtgccactgcaagaccaactgcgaggacttcatcagcaacatcgtgatcagcccccagatcaagacctacaacatcaaggtgcactgcaagagcaaggtggagaagatcaccgccaacatctgcggcagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactgggccatcctgatctacagcatcatcggcgtgatcgtggtgatcctgctgatctacgtgctgctgcccatcggcagactgctgaaggccttcctgatcaagaacgagatcgagtacaccatggagcagaagatcaagtga

SEQ ID NO: 9413 - RNA, 4263 nt, synthetic construct
  misc_feature 1..4263: note = derived and/or modified CDS sequence (opt4) from OROV(TVP-19257/IQT-1690)__KP795088.1__GP
  source 1..4263: mol_type = other RNA
atggccaacctgatcatcatccccatgatcctgggcatcgcctacggccaccccctgagcaccagccagatcggcgacagatgcttcgccggcggcagcctgttcaaggagatgaacctgagcgtgggcctgggcgagatctgcgtgaaggacgacatcagcatcgtgaagagcaccaccgccttcagcaagaacgccctggccctggaggccaccaccaagttctacagaagcttcatcgtgaaggactggagcgagtgcaaccccgtgctggacaagttcggcaacttcatggtgctgaacgtggacgacaacggccacctggtgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagagaagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacatcgcctacctgctgctgcccctgttctaccccgtgacctggctgtacggcaaggtgtacaagagaatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagctggccgagcaggtgaacatcctgggcaaggagatcaagatcctgaagcagagcatcatcgtgatgctggccatcatcctgatcctgctgctgagcgagaacatcatcttcaactacctgttcaacaccctgtacagaagctgcagcatgtgcggcctgatccactacagacccggcctgaaggtggacctgaccaagaccaacaagtgcggcagctgcatctgcggcttcgacgagcagcagagcagcggcttcgagtacgaggtgttcctgaaggacatgcacgtgcagagagagagctgcaagttcggccccagagtgaaccacttcagaaacaccaagatcctgctgttcatcatcgccatctgcaccagcttctacaccgtgtacgccgacgaggactgcctgagcaagaacatcagaatcacctaccaggagctgcacaactgcatcggcccccacatcatgggcgacacctgcatgagcaagagcgagctgtacagcgacctgctgagcaagaacctgatcaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgacttcaacaaggagatcgagacctactacaaggccaacgccgccgcctacagaagcgacttcaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatggtgggcgtgctgaagttcgccagcaagctgctgaacatcagcctgggcagaaccaccagaagcgcccagcacagcatcatgaccaacgagatccccaagagcaaccccttcaccgactacagctacagcagcgtgaacatcaaggagtgcatgagccccgagagcctgaagtgcttcaagaagagagacagcgccccccacaccaaccacctgctgtgcaagatggacaacaagtacaaggccttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcgtgaagaagtgcagcgccgacgagatcggcgagtgcatcaccctggaggacaagagctggcccatcgtgttctgcggcgacaagtactactacagcgacggcaaggagcacgccaaggacggcagcatcaacaactactgcctggccaacaagtgcagcgagcagagattccccatccacaagaactggttcaagaagtgcaactgggacaagacccacaaggagttcaccaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcaagggcaaccagctgttcgacatcgtgatcttcgtgaagaaggccgtgtacaaggcccagtaccagaaggtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgctggagatctgcatcaccctgccccacgagacctactgcaacgacatggacatcctggagcccatcatcggcgacaagctgagcgccagcttccagaacacccagaccaaccagctgcccaacctgatggcctacaagaagggcaaggtgtacaccggccagatcaacgacgtgggcaacaccgccctgcagtgcggcagcatccaggtggtgaacggcagcaccatcggcagcggcaaccccaagttcgactacatctgccacgccatgagaagaaaggacgtgatcgtgagaaagtgcttcaacgacaactaccagagctgcaccagactggaccccagaaacgacctgatcccctacagaaagggcgacatcatcgagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgtgagcgccgagaccgtgtgccactgcaagaccaactgcgaggacttcatcagcaacatcgtgatcagcccccagatcaagacctacaacatcaaggtgcactgcaagagcaaggtggagaagatcaccgccaacatctgcggcagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactgggccatcctgatctacagcatcatcggcatcatcgtggtgatcctgctgatctacgtgctgctgcccatcggcagactgctgaaggccttcctgatcaagaacgagatcgagtacaccatggagcagaagatcaagtga

SEQ ID NO: 9414 - RNA, 4263 nt, synthetic construct
  misc_feature 1..4263: note = derived and/or modified CDS sequence (opt4) from OROV(TVP-19258/IQT-4083)__KP795091.1__GP
  source 1..4263: mol_type = other RNA
atggccaacctgatcatcatcagcatgatcctgggcatcgcctacggccaccccctgagcaccagccagatcggcgacagatgcttcgccggcggcagcctgttcaaggagatgaacctgagcgtgggcctgggcgagatctgcgtgaaggacgacatcagcatcgtgaagagcaccaccgccttcagcaagaacgccctggccctggaggccaccaccaagttctacagaagcttcatcgtgaaggactggagcgagtgcaaccccgtgctggacaagttcggcaacttcatggtgctgaacgtggacaacaacggccacctggtgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagagcctgcatcagattcttcaagggcacctacatgccctacagcatgatcgaggccatgtgcgtgaacatcgagctgatcatcctgaccctgtacatcttcgccgccatcatcttcgccctgatcatcaccaagagctacatcgcctacctgctgctgcccctgttctaccccgccacctggctgtacggcaaggtgtacaagagaatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagctgaccgagcaggtgaacatcctgggcaaggagatcaagatcctgaagcagagcatcatcgtgatgctggccatcatcctgatcctgctgctgagcgagaacatcatcttcaactacctgttcaacaccctgtacagaagctgcagcatgtgcggcctgatccactacagacccggcctgaaggtggacctgaccaagaccaacaagtgcggcagctgcatctgcggcttcgacgagcagcagagcagcggcttcgagtacgaggtgttcctgaaggacatgcacgtgcagagagagagctgcaagttcggccccagagtgaaccacttcagaaacaccaagatcctgctgttcaccatcgccatctgcaccagcttctacaccgtgtacgccgacgaggactgcctgagcaagaacatcagaatcacctaccaggagctgcacaactgcatcggcccccacatcatgggcgacacctgcatgcccaagagcgagctgtacagcgacctgctgagcaagaacctgatcaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgacttcaacaaggagatcgagacctactacaaggccaacgccgccgcctacagaagcgacttcaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatggtgggcgtgctgaagttcgccagcaagctgctgaacatcagcctgggcagaaccaccagaagcgcccagcacagcatcatgaccaacgagatccccaagagcaaccccttcaccgactacagctacagcagcatcaacatcaaggagtgcatgagccccgagagcctgaagtgcttcaagaagagagacagcgccccccacaccaaccacctgctgtgcaagatcgacaacaagtacaaggccttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcatcaccctggaggacaagagctggcccatcatcttctgcggcgacaagtactactacagcgacggcaaggagcacgccaaggacggcagcatcaacaactactgcctggccaacaagtgcagcgagcagagattccccatccacaagaactggttcaagaagtgcaactgggacaagacccacaaggagttcaccaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcaagggcaaccagctgttcgacatcgtgatcttcgtgaagaaggccgtgtacaaggcccagtaccagaaggtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaacctgatggcctacaagaagggcaaggtgtacaccggccagatcaacgacgtgggcaacaccgccctgcagtgcggcagcatccaggtggtgaacggcagcaccatcggcagcggcaaccccaagttcgactacatctgccacgccatgagaagaaaggacgtgatcgtgagaaagtgcttcaacgacaactaccagagctgcaccagactggaccccagaaacgacctgatcccctacagaaagggcgacatcatcgagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgtgagcgccgagaccgtgtgccactgcaagaccaactgcgaggacttcatcagcaacatcgtgatcagcccccagatcaagacctacaacatcaaggtgcactgcaagagcaaggtggagaagatcaccgccaacatctgcgagagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactgggccatcctgatctacagcatcatcggcatcatcgtggtgatcctgctgatctacgtgctgctgcccatcggcagactgctgagagccttcctgatcaagaacgagatcgagtacaccatggagcagaagatcaagtga

SEQ ID NO: 9415 - RNA, 4263 nt, synthetic construct
  misc_feature 1..4263: note = derived and/or modified CDS sequence (opt4) from OROV(TVP-19259/IQT-7085)__KP795094.1__GP
  source 1..4263: mol_type = other RNA
atggccaacctgatcatcatcagcatgatcctgggcatcgcctacggccaccccctgagcatcagccagatcggcgacagatgcttcgccggcggcagcctgttcaaggagatgaacctgagcgtgggcctgggcgagatctgcgtgaaggacgacatcagcatcgtgaagagcaccaccgccttcagcaagaacgccctggccctggaggccaccaccaagttctacagaagcttcatcgtgaaggactggagcgagtgcaaccccgtgctggacaagttcggcaacttcatggtgctgaacgtggacgacaacggccacctggtgcccaagatgtacacctgcagagccgcctgcgacatcagactgaacaaggacaacgccgagatcatcctgagcagcaccaagctgaaccacttcgagatcgtgggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacatcgcctacctgctgctgcccctgttctaccccgtgacctggctgtacggcaaggtgtacaagagaatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagctggccgagcaggtgaacatcctgggcaaggagatcaagatcctgaagcagagcatcgtggtgatgctggccatcatcctgatcctgctgctgagcgagaacatcatcttcaactacctgttcaacaccctgtacagaagctgcagcatgtgcggcctgatccactacagacccggcctgaaggtggacctgaccaagaccaacaagtgcggcagctgcatctgcggcttcgacgagcagcagagcagcggcttcgagtacgaggtgttcctgaaggacatgcacgtgcagagagagagctgcaagttcggccccagagtgaaccacttcagaaacaccaagatcctgctgttcaccatcgccatctgcaccagcttctacaccgtgtacgccgacgaggactgcctgagcaagaacatcagaatcacctaccaggagctgcacaactgcatcggcccccacatcatgggcgacacctgcatgagcaagagcgagctgtacagcgacctgctgagcaagaacctgatcaccgagtacgacaagaagtacttcgagcccgacaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgacttcaacaaggagatcgagacctactacaaggccaacgccgccgcctacagaagcgacttcaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatggtgggcgtgctgaagttcgccagcaagctgctgaacatcagcctgggcagaaccaccagaagcgcccagcacagcatcatgaccaacgagatccccaagagcaaccccttcaccgactacagctacagcagcgtgaacatcaaggagtgcatgagccccgagagcctgaagtgcttcaagaagagagacagcgccccccacaccaaccacctgctgtgcaagatggacaacaagtacaaggccttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcatcaccctggaggacaagagctggcccatcgtgttctgcggcgacaagtactactacagcgacggcaaggagcacgccaaggacggcagcatcaacaactactgcctggccaacaagtgcagcgagcagagattccccatccacaagaactggttcaagaagtgcaactgggacaagacccacaaggagttcaccaccatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcaagggcaaccagctgttcgacatcgtgatcttcgtgaagaaggccgtgtacaaggcccagtaccagaaggtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaacctgatggcctacaagaagggcaaggtgtacaccggccagatcaacgacgtgggcaacaccgccctgcagtgcggcagcatccaggtggtgaacggcagcaccatcggcagcggcaaccccaagttcgactacatctgccacgccatgagaagaaaggacgtgatcgtgagaaagtgcttcaacgacaactaccagagctgcaccagactggaccccagaaacgacctgatcccctacagaaagggcgacatcatcgagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgtgagcgccgagaccgtgtgccactgcaagaccaactgcgaggacttcatcagcaacatcgtgatcagcccccagatcaagacctacaacatcaaggtgcactgcaagagcaaggtggagaagatcaccgccaacatctgcggcagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactgggccatcctgatctacagcatcatcggcgtgatcgtggtgatcctgctgatctacgtgctgctgcccatcggcagactgctgaaggccttcctgatcaagaacgagatcgagtacaccatggagcagaagatcaagtga

SEQ ID NO: 9416 - RNA, 4263 nt, synthetic construct
  misc_feature 1..4263: note = derived and/or modified CDS sequence (opt4) from OROV(TVP-19262/OBS-9478)__KP795100.1__GP
  source 1..4263: mol_type = other RNA
atggccaacctgatcatcatcagcatgatcctgggcatcgcctacggccaccccctgagcaccagccagatcggcgacagatgcttcgccggcggcagcctgttcaaggagatgaacctgagcgtgggcctgggcgagatctgcgtgaaggacgacatcagcatcgtgaagagcaccaccgccttcagcaagaacgccctggccctggaggccaccaccaagttctacagaagcttcatcgtgaaggactggagcgagtgcaaccccgtgctggacaagttcggcaacttcatggtgctgaacgtggacaacaacggccacctgatccccaagatgtacacctgcagagccgcctgcgacatcagactgaacaaggacaacgccgagatcatcctgagcagcaccaagctgaaccacttcgagatcatcggcaccaccagcaccagcggctggttcaagaacaccatcaccaacaacctggagcacacctgcgagcacgtgaccgtgaactgcggccagaagagcgtgaagttccacgcctgcttcagacagcacagaggctgcatcagattcttcaagggcacctacatgccctacagcatgatcgaggccatgtgcgtgaacatcgagctgatcatcctgaccctgtacatcttcgccgccatcatcttcgccctgatcatcaccaagagctacatcgcctacctgctgctgcccctgttctaccccgccacctggctgtacggcaaggtgtacaagagaatcaacagctgccccaactgcctgctggccagccaccccttcaccagctgccccaagatctgcatctgcggcagcagattcagctgcaccgaggccctgaaggtgcacagaatgggcaaggactgcctgggctacaagagcctgagcaaggccagacagatgtgcaagagcaagagctggagcttcaccgccgccatcctgaccggcctgatcctgatggagttcgtgagccccatcgccggcgagagaatgtacaagctggaggagctggccgacgactacatcgagctgaccgagcaggtgaacatcctgggcaaggagatcaagatcctgaagcagagcatcatcgtgatgctggccatcatcctgatcctgctgctgagcgagaacatcatcttcaactacctgttcaacaccctgtacagaagctgcagcatgtgcggcctgatccactacagacccggcctgaaggtggacctgaccaagaccaacaagtgcggcagctgcatctgcggcttcgacgagcagcagagcagcggcttcgagtacgaggtgttcctgaaggacatgcacgtgcagagagagagctgcaagttcggccccagagtgaaccacttcagaaacaccaagatcctgctgttcaccatcgccatctgcaccagcttctacaccgtgtacgccgacgaggactgcctgagcaagaacatcagaatcacctaccaggagctgcacaactgcatcggcccccacatcatgggcgacacctgcatgcccaagagcgagctgtacagcgacctgctgagcaagaacctgatcaccgagtacgacaagaagtacttcgagcccggcaccgtgaacgaccagttcaacaagatcgagttcgcccaggacgcccacagaatgatcctgctggagagaatcctgtacaagaccgagtgcgagatgctgagcctgaagaagaacagcggcccctacaacgtggcctggagaacctacctgaagaaccacaacatcgacctgtgcagcagacacaactacaagatgatctgccagtgcatcaacacccacagcatgtgcaagaacaccgacatcgacttcaacaaggagatcgagacctactacaaggccaacgccgccgcctacagaagcgacttcaacaccatcatcgacaccctgaagaccgccttcagaggcctgaccaaggtgctgatcgagaactacatcgagaaggacgacagcgacgccctgaaggccctgttcagcaacatcaccgacagcgtgcaggacaactaccagatggtgggcgtgctgaagttcgccagcaagctgctgaacatcagcctgggcagaaccaccagaagcgcccagcacagcatcatgaccaacgagatccccaagagcaaccccttcaccgactacagctacagcagcatcaacatcaaggagtgcatgagccccgagagcctgaagtgcttcaagaagagagacagcgccccccacaccaaccacctgctgtgcaagatcgacaacaagtacaaggccttcgactggcccgagatcgagaccgtgcagaagggccagaagctgtgcctgggcgacagccactgcaacctggagttcaccgccatcaccgccgacaagatcatgagcctgaccaactgctacaaggagagcttcaccgcccagcccgccgacatgcagaccggcatcaagaagtgcagcgccgacgagatcggcgagtgcatcaccctggaggacaagagctggcccatcatcttctgcggcgacaagtactactacagcgacggcaaggagcacgccaaggacggcagcatcaacaactactgcctggccaacaagtgcagcgagcagagattccccatccacaagaactggttcaagaagtgcaactgggacaagacccacaaggagttcaccatcatgagacagatcaactacaacgacatcaccagctacagaaaggccatcgagagcgagatcggcaccgacctgatgacccaccactacaagcccaccaagaacctgccccacgtggtgcccagataccacagcatcgacgtgcagggcaccgagagcaccgagggcatcatcaacggcttcatccagaacaccatccccgccatcagcggcctgggcgtgggctaccacctgggcttcaagggcaaccagctgttcgacatcgtgatcttcgtgaagaaggccgtgtacaaggcccagtaccagagagtgtacaccaccggccccagcatcagcatcaacatcgagcacaacgagaagtgcaccggccactgccccgagaagatccccgccaaggagggctggctgaccttcagcaaggagcacaccagcagctggggctgcgaggagtacggctgcctggccatcgacaccggctgcctgtacggcagctgccaggacgtgatcagacccgagctggacatctacaagaagatcggcagcgaggccagcctgatcgagatctgcatcaccctgccccacgagacctactgcaacgacatggacatcctggagcccatcatcggcgacaagctgagcgccagcttccagaacacccagaccaaccagctgcccaacctgatggcctacaagaagggcaaggtgtacaccggccagatcaacgacgtgggcaacaccgccctgcagtgcggcagcatccaggtggtgaacggcagcatcatcggcagcggcaaccccaagttcgactacatctgccacgccatgagaagaaaggacgtgatcgtgagaaagtgcttcaacgacaactaccagagctgcaccagactggaccccagaaacgacctgatcccctacagaaagggcgacatcatcgagatcagcaagaccggcagcaacatgggccagatgaccttcaagatcgagctgggcgacatcaactacaagatcttcaccaagagcgtggacctgcagatgagcggcatctgcgccggctgcatcgactgcgccgagggcatcagctgcagcatcaacgccgacgtgagcgccgagaccgtgtgccactgcaagaccaactgcgaggacttcatcagcaacatcgtgatcagcccccagatcaagacctacaacatcaaggtgcactgcaagagcaaggtggagaagatcaccgccaacatctgcgagagaaacatcgacctgcagctgaccgtgaagccctacaaccagaagatcgacctgagccagctggacgagagcaactacatcaaggaggaggacctgcagtgcggcacctggctgtgcaaggtgcagaaggagggcatcgacatcgtgttcaagggcctgttcagcggcctgggcaagtactgggccatcctgatctacagcatcatcggcatcatcgtggtgatcctgctgatctacgtgctgctgcccatcggcagactgctgagagccttcctgatcaagaacgagatcgagtacaccatggagcagaagatcaagtga

SEQ ID NO: 9417 - RNA, 4299 nt, synthetic construct
  misc_feature 1..4299: note = derived and/or modified CDS sequence (opt4) from OROV/FPV(Aus Ch 16129)__KF697137.1__GP
  source 1..4299: mol_type = other RNA
atgaagttcgtgagcatcctgctgttcgtgagctggctgggcgccacctaccagaaccccgtgagccacagacagatcggcgagagatgcttcgccggcggcagcctgatcaagaccgtgaaccagaccagcggcgtgagcgaggtgtgcgtgagagacgacatcagcatgatcaagagcatcgtgcacaccaccaaggccagcgacaccgccgtgaacaactacatcagattctacagagtgttcatcgtgaaggagtggcacgactgcaaccccttccccgaccccaagggcaccttcatggtgctggacgtgagcagcaccaaccacctggagcccatcacctacacctgcagaaccccctgcgagatcaccctggacaaggacagcgccgaggtgaccctgagcagccagaagatgaaccactacgagatcagcggcagcaccatcaacaacggctggttcaagaacagcatcagcgtgagcctggagcacacctgcgagcacatcaccgtgagctgcggccagaagaccgtgagattccacgcctgcttcagacagcacagaagctgcaccagattcttcaagaacagcatgatgcccgccagaatgaccgagagcatctgccagaacctggagatcatcctgctgacctgcttcagcttcgtgtgcttcatcttcctgtgcatcatcaccaagacctacgtggcctacgtgctgatccccgtgttctaccccttcacctacatctacggcagactgtacgacaagtacttcaagctgtgcgagaactgcctgctggccgtgcaccccttcaccccctgcgagaccgtgtgcgtgtgcggcagccagtacgccaacaccgagcagctgagaacccacagaatgaccaacaactgcaagggctacaagagcctgagcaagagcagagccatgtgcaagagcaagggctgcagcttcgtggtggccatcttctgcagcatcatcttcttcagcttcatcacccccatcaacagccaggagtacaagctgagcgacctgcccgacgagttcaccagactggaggaggagaacaccatgctgaagatcagactgctggtgatcaagatcaccatcagcgtgatcagcgtgaccatcaccgtgaccagcctgaccgagagaaaggtgttccaggagctgttcaacgccatctacagacactgccccttctgcggcatgatccacagaagaagaggcctgagagtggtgaacagcaccaccaacaagtgcggcacctgcatctgcggctacaaggaggagaccgagcacggcgtggagtacgagatcttcctgaagaccatgcaccaggagaacgtgaactgcatgttcaagcccagccagagacacttcagaaacttcaagatcctgatcgccttcctggccatgtgcatgatcatcaccagcgtgagcgccgacgagaagcactgcctgaagtacaaggagcccgtgaagctgagcaacctgaccgagtgccacagcctgtggctgaacatcaccgagtgccagatcaaccagagcaccctgttcgagaccctgaagggcgagcagctggtgaccgacttcgacaagcccgacttcaccatcatgggccagaagtacgacatcgccatggagagaatcgagaacgcccagaacctgcaccacatgatcctgctggagtacctgcacgccaagagcaactgcctgaagtacaagcagctgaagagcaacagcggcccctacaacatcccctggagaacctacatccacggccacggcctggacgtgtgcggccagtacagctacaagctgatctgcaagtgcatcagcaccggcatgcactgcgagaacaccgccctggacatctacaacgagatgagacagttctacaccaacaaccaggagaactacaacctggacctgaacaccgtgatcaaggccatcggcctggccatgagaggcatcggccagatgatcatcgaggagttcttcggcgagagccagatcgaggagctgagcaacttcctgaacatgaccagcaagaacctgggcaccaacaagcagctgatcggcctgatcaacttcggcctgatgctgctggacatcaaccagaccaagaccccccagatcgaccccaagcccagaaccctgcaggccagaagcagcatccccaccggcaccgagatcaccgactggaccaagggccagagcaagatcaagacctgcgccgagtacagcaccctgacctgccagagctggagaaagaccgtgaacaccaagagcttcctgatgtgcaaggtgagcagcaagtggcacgtgtacaactggcccgagatccccaccgtggtgagaaacagcaagctgtgcctgggcgactaccactgcaacatggagttcacccccatcgacgccgacgaggccctgaagcagctgagatgctacaagaccgagttcgtgcccagccccgacggcatggacgagagcatcaagaagtgcaccctggagaagttcggcggctgcaccaccgccaacggccacagctggaccatcatggtgtgcaacggcagatactaccagaccaacaccagagagcacgccaaggacggcctgctgaacagctactgcttcgagcccaagtgccagagcggcagacaccccatccacaagagcttcctgaacaactgcatctggaaggagagcagcagacagatcatcgagaccagaaccatcgagtacaacaacatcgaggactacaagaagagcgtggagagcgacatcaagagcgacctgaccatccaccacttcaagcccaccaagaacctgcccctggtgacccccacctacatcagcgtggtggccgacggcaccatggtgagcgacggcatccagaacgcctacgtgaagggcaccatccccggcatcagcggcgtggccaccggcctgcacgtgaagacccccgacggcatcctgctgatggacatcatcgtgtacgtgagaaaggccctgtacaaggccaactacgagaagatctacagcaccggccccaccatcggcatcaacgtgaagcacaacgagaagtgcaccggcacctgccccgagcacatccccaaggacgagggctggctgaccttcagcaaggagcacaccagcaactggggctgcgaggagtacggctgcttcgccatcaacagcggctgcctgtacggcagctgccaggacatcatcagacccgagctggacatctacaagcagcagggcgaggagcagaccctgctggagctgtgcatcaccctgccccacgagaccttctgcaacgacctggacgtgctggagcccgtgatcaccgacaagctgcagctggacttccagaccacccagagcgaccacctgcccgagctggtggccctgaagaagggcctgatcctgaccggccagctgaacgacctgggcaacaccgccgccatgtgcggcagcgtgcagctggtgaacaagaccatctacggccagggcaaccccaagttcgacttcatctgccacgccatgagaagaaaggacgtgatcgtgagaagatgctacgacaaccactacagcacctgcgccctgctgaagcagagaaacgacctgctgcacaaggaggtgaacgaccagatgagcatcaccgtgaacggcaagaacctgggcctgatcaacttcagactgaacctgggcgacctgaactacaagctgttcgtgaacgagcccaacttcgagctgaccggccagtgcgccggctgcatcagctgcgccgacgagatcagctgccagctgaacatcatcgccgaccacgagttcacctgcaaggtgagcagcagctgcaacctgtacatcagcaacatgatgatcacccccgccaaccacatctacaacctgaaggtgagctgcagagagcacgtgagcaacatcgacctggccgtgtgcggcagaagcttcagcctgcacgccaccctgaagcagcacagccagaagctggacctgagcgccctggacgagaccaacttcgtgaaggaggaggacctgagatgcggcacctggctgtgcaaggtgaaggacgagggcctgagcttcctgaccagaagcatcttcggcagcctgggcacctactggagctacttcatctacggcctgatcttcatgatcctgctgttcatcgccatctacttcctgtaccccctgtgcaagagactgaagggcctgctggaggagaacgagagagagtacctgatcgagagcaagatgaagtga

SEQ ID NO: 9418 - RNA, 4257 nt, synthetic construct
  misc_feature 1..4257: note = derived and/or modified CDS sequence (opt4) from OROV/IQTV(IQT9924)__KF697143.1__GP
  source 1..4257: mol_type = other RNA
atggactgcatcatcttctacctgagcttcttcgccgtggtgaccgcccaccccgtgagccaccaccaggtgggcgacagatgcttcgccggcggcaacctgatcaaggacctgaacaagaccgtgaacatcggcgaggtgtgcgtgagagacgacatcagcatcatcaagagcaccaccgccatccagaagagcctggaccacctgagcaccagaaccaagttctacagagtgtacatcgtgaaggagtgggccgagtgcaaccccatcatcgactacgccggcaacttcatcgtgatgaacatcgacgacaacggccacctggtgcccagaatgcacacctgcagagccagctgcgacatcagactgaacaagaacgacgccgagatcatcctgagcagccagaagaccaaccactacgagatcatcggcaccaccaccgtgagcggctggttcaagaacaccatcaacctgcccctggagcacacctgcgagcacatcaccgtgaactgcggccagaagagcctgagattccacgcctgcttcagaatgcacagaggctgcaccagattcttcaagaacacctacatgcccagcaccatgatcgagcacatgtgcgtgaacctggagctgatcatcttcaccctgtacatcttcaccgccctggtgttcgcctacatcatcaccaagagctacatcgcctacatcctgctgcccctgttctaccccctgacctacgtgttcggcatcatctacagcaagctgaagcagtgcaagacctgcatgctggccgcccaccccttcaccaactgccccaagagatgcgtgtgcggcagcagattcaactgcaccgaggccctgagagtgcacagactgggcagagactgccagggctacaagagcctgagcaaggccagacagatgtgcaagagcaagagctggagcttcatcatcgccatcttcaccggcctgatcctgatggagttcatcacccccatccacggcgagagaacctacaagctgagcgagctggccgacgagttcatcgccatgaagaccgaggtgaccgtgatgcagagaagcatctacaaccagaagatcctgaacatcgccctgctgaccctggtggtgctgatcatcctgctggagacctacatcttcaagatcctgttcagcctgctgtacagaagctgcagcatgtgcggcctgatccactacaaggtgggcctgaagatcaacctgctgaccaccaacaagtgcggcacctgcatctgcggcttcagcgagcagcagagcagcggcttcgagtacgaggtgttcctgaaggacatgcacaagcagagagagagctgcaagtacttccccatgctgaaccacttcagaaacctgaagatcctgaccaccatcctgctgctgatcctgctggccaccagcgtgagcagcgagtgcctgcagaagcccctgaagatcaagctggaggacctgcacgagtgcatcggcgtgaacttcctggacaagcagtgctacaacagaaagaacctgtacgagagcctgagaagcaagaacctgatcagcgaggtggacaagaagtacttcgagaacgccgacctggagggccagttcaagagaatcgagtacgcccaggacgcccacagaatgatcctgctggagagaatcctgtacagcaccgagtgcgagatgcacaccatcctgaccaacggcggcgcctacaacatcccctggagaacctacctgaagaaccacaacctgaacctgtgcggcaagcacgtgcacaagatggtgtgccagtgcgtgaacacccacacccagtgcctgagcaccggcatcgactaccaggacgagatcaccaagttctaccaggccgacggcgacagctacagaagcgacctgagcatcatcctggagaccatcagcaccgccttcagaggcctgaccaaggtgctgatcgagacctacatcgagcaggacaacagcgagagcatgatcaagctgctgaacaccatccagggcaaggtgcccaacaactaccagatgctgggcatcctgaagttcgccatcaagatcatgaacatcaaccagaccagaggcgtgagaagcgccagacacaccatcgtgagcaacgacatccccatgagcgagcccttcagcaacttcgaggtgagcaacatcaacatcaagcagtgcctggagcccctgaccctgaagtgcttcaccaagagaggcgacagcccccacagcaaccacctgctgtgcaaggagcagagcaagtacaaggtgttcgagtggcccgaggtggagaccgtgaccaagaacaacaagctgtgcctgggcgacacccactgcaacctgaagttcaccgccaccaccagcgacgagatcatcaagctgctgaactgcttcagcgacacctacaagcccaaccccggcgagatggagatcggcctgaagaagtgcaacgccgagaagatcggcgagtgcgtgaccctggagaacagcccctggcccatcgtgtactgcgagaacaagtactactacagcgaggccaaggagcacgccaaggacggcagcgtgaacagctactgcctgaccaacaagtgcaccgaggacagactgcccatcaaccccgcctggttcaagagctgcaactgggagaagaacatcaaggagaccgccaccatcaaggagttcgtgtacaacgacatcaagagctacagaaagagcctggagagcgagatcaacaccgacctgatgatccaccactacagacccaccaagaacctgccccacatcaagcccatctacaagagcctgagcatccagggcagcgagaccgtggacggcctgcagaacagcttcatcgagggcgagatgcccgccatcagcggcctggccaacggctaccacctgatgtacaagggcacccagctgttcgacatcgtgatcttcatcagaaaggccgtgtacaaggccaactactacaagatctacaccaccggccccagcatcgccatcaacatggagcacaacgagcagtgcaccggccactgccccagcaagatccccagcaaggagaactggctgaccttcagcagagagcacaccagcagctggggctgcgaggagtacggctgcctggccatcgacaccggctgcctgtacggcagctgccaggacgtgatcagacccgagatcgacgtgtacaagaagagcggcaccgagcagagcctgatcgagctgtgcatcaccagcgcccacgagaccttctgcaacgacctggacatcctggagcccatcatcggcgagaagatcagcgccagcttccagagcacccagagcaaccagctgcccaacatcatcgccttcagaaagggccagatcctgaccggcgccatcaacgacctgggcaacaccggcagccagtgcggcagcatccagctggtgaacaacaccctgctgggcgagggcaacgtgaagttcgactacatctgccacgccatgagaagaaaggacgtgatcatcagaagatgctacaacgaccacttcaccagctgcaacctgctgcagaagagaagcgacctgatcggcaacatcaacggcaaggagctgcagatcagcatgagcggcagaagcatgggcagcatgaagttcaagatcgagctgggcgacatcaactacaagctgtacaccgagaacgccgacatcaccatcagaggcgagtgcggcggctgcatcggctgcgccgaggccgtgagctgcagcctggaggtggagagcgccagcgagatcctgtgcaaggtggagtgcaactgccagccctacatcgagaacatcctgatcaagccccagaccaagacctacagcttcaaggccacctgcctggagaagagcaacaccctggacatcaagatctgcggcaagcagatcatcgcccccctgaccatcaagagctacaaccagaagatcgacctgagcaagctggacgagagcaactacgtgaaggaggaggacctggcctgcaacacctggctgtgcaaggtgcagaccgagggcttcaacttcgtgttcagcggcctgttcgccggcttcggcagatactggaccatcgccatctacatcctgatcgccgtggtgatcatcctgatcctgatctacatcctgatgcccatcttcagactgatcagaaccttcctgatcaagaacgagatcgagtacaccaccgagcagaagatgagatga

SEQ ID NO: 9419 - RNA, 4257 nt, synthetic construct
  misc_feature 1..4257: note = derived and/or modified CDS sequence (opt4) from OROV/IQTV(MIS-0397)__KJ866387.1__GP
  source 1..4257: mol_type = other RNA
atggactgcatcatcttctacctgagcttcttcgccgtggtgaccgcccaccccgtgagccaccaccaggtgggcgacagatgcttcgccggcggcaacctgatcaaggacctgaacaagaccgtgaacatcggcgaggtgtgcgtgagagacgacatcagcatcatcaagagcaccaccgccatccagaagagcctggaccacctgagcaccagaaccaagttctacagagtgtacatcgtgaaggagtgggccgagtgcaaccccatcatcgactacgccggcaacttcatcgtgatgaacatcgacgacaacggccacctggtgcccagaatgcacacctgcagagccagctgcgacatcagactgaacaagaacgacgccgagatcatcctgagcagccagaagaccaaccactacgagatcatcggcaccaccaccgtgagcggctggttcaagaacaccatcaacctgcccctggagcacacctgcgagcacatcaccgtgaactgcggccagaagagcctgagattccacgcctgcttcagaatgcacagaggctgcaccagattcttcaagaacacctacatgcccagcaccatgatcgagcacatgtgcgccaacctggagctgatcatcttcaccctgtacatcttcaccgccctggtgttcgcctacatcatcaccaagagctacatcgcctacatcctgctgcccctgttctaccccctgacctacgtgttcggcatcatctacagcaagctgaagcagtgcaagacctgcatgctggccgcccaccccttcaccaactgccccaagagatgcgtgtgcggcagcagattcaactgcaccgaggccctgagagtgcacagactgggcagagactgccagggctacaagagcctgagcaaggccagacagatgtgcaagagcaagagctggagcttcatcatcgccatcttcaccggcctgatcctgatggagttcatcacccccatccacggcgagagaacctacaagctgagcgagctggccgacgagttcatcgccatgaagaccgaggtgaccgtgatgcagagaagcatctacaaccagaagatcctgaacatcgccctgctgaccctggtggtgctgatcatcctgctggagacctacatcttcaagatcctgttcagcctgctgtacagaagctgcagcatgtgcggcctgatccactacaagctgggcctgaagatcaacctgctgaccaccaacaagtgcggcacctgcatctgcggcttcagcgagcagcagagcagcggcttcgagtacgaggtgttcctgaaggacatgcacaagcagagagagagctgcaagtacttccccatgctgaaccacttcagaaacctgaagatcctgaccaccatcctgctgctgatcctgctggccaccagcgtgagcagcgagtgcctgcagaagcccctgaagatcaagctggaggacctgcacgagtgcatcggcgtgaacttcctggacagacagtgctacaacagaaaggacctgtacgagagcctgagaagcaagaacctgatcagcgaggtggacaagaagtacttcgagagcgccgacctgggcggccagttcaagagaatcgagtacgcccaggacgcccacagaatgatcctgctggagagaatcctgtacagcaccgagtgcgagatgcacaccatcctgaccaacggcggcgcctacaacatcccctggagaacctacctgaagaaccacaacctgaacctgtgcggcaagcacgtgcacaagatggtgtgccagtgcgtgaacacccacacccagtgcctgagcaccggcatcgactaccaggacgagatcaccaagttctaccaggccgacggcgacagctacagaagcgacctgagcatcatcctggagaccatcagcaccgccttcagaggcctgaccaaggtgctgatcgagacctacatcgagcaggacaacagcgagagcatgatcaagctgctgaacaccatccagggcaaggtgcccaacaactaccagatgctgggcatcctgaagttcgccatcaagatcatgaacatcaaccagaccagaggcgtgagaagcgccagacacaccatcgtgagcaacgacatccccatgagcgagcccttcagcaacttcgaggccagcaacatcaacatcaagcagtgcagcgagcccctgaccctgaagtgcttcaccaagagaggcgacagcccccacagcaaccacctgctgtgcaaggagcagagcaagtacaaggtgttcgagtggcccgagatcgagaccgtgaccaagaacaacaagctgtgcctgggcgacacccactgcaacctgaagttcaccgccaccaccagcgacgagatcatcaagctgctgaactgcttcagcgacacctacaagcccaaccccggcgagatggagatcggcctgaagaagtgcaacgccgagaagatcggcgagtgcgtgaccctggagaacagcccctggcccatcgtgtactgcgagaacaagtactactacagcgaggccaaggagcacgccaaggacggcagcgtgaacagctactgcctgaccaacaagtgcaccgaggacagactgcccatcaaccccgcctggttcaagagctgcaactgggagaagaacatcaaggagaccgccaccatcaaggagttcgtgtacaacgacatcaagagctacagaaagagcctggagagcgagatcaacaccgacctgatgatccaccactacagacccaccaagaacctgccccacatcaagcccatctacaagagcctgagcatccagggcagcgagaccgtggacggcctgcagaacagcttcatcgagggcgagatgcccgccatcagcggcctggccaacggctaccacctgacctacaagggcacccagctgttcgacatcgtgatcttcatcagaaaggccgtgtacaaggccaactactacaagatctacaccaccggccccagcatcgccatcaacatggagcacaacgagcagtgcaccggccactgccccagcaagatccccagcaaggagaactggctgaccttcagcagagagcacaccagcagctggggctgcgaggagtacggctgcctggccatcgacaccggctgcctgtacggcagctgccaggacgtgatcagacccgagatcgacgtgtacaagaagagcggcaacgagcagagcctgatcgagctgtgcatcaccagcgcccacgagaccttctgcaacgacctggacatcctggagcccatcatcggcgagaagatcagcgccagcttccagagcacccagagcaaccagctgcccaacatcatcgccttcagaaagggccagatcctgaccggcgccatcaacgacctgggcaacaccggcagccagtgcggcagcatccagctggtgaacaacaccctgctgggcgagggcaacgtgaagttcgactacatctgccacgccatgagaagaaaggacgtgatcatcagaagatgctacaacgaccacttcaccagctgcaacctgctgcagaagagaagcgacctgatcggcaacatcaacggcaaggagctgcagatcagcatgagcggcagaagcatgggcagcatgaagttcaagatcgagctgggcgacatcaactacaagctgtacaccgagaacgccgacatcaccatcagaggcgagtgcggcggctgcatcggctgcgccgaggccgtgagctgcagcctggaggtggagagcagcagcgagatcctgtgcaaggtggagtgcaactgccagccctacatcgagaacatcctgatcaagccccagaccaagacctacagcttcaaggccacctgcctggagagaagcaacaccctggacatcaagatctgcggcaagcagatcatcgcccccctgaccatcaagagctacaaccagaagatcgacctgagcaagctggacgagagcaactacgtgaaggaggaggacctggcctgcaacacctggctgtgcaaggtgcagaccgagggcttcaacttcgtgttcagcggcctgttcgccggcttcggcagatactggaccatcgccatctacatcctgatcgccgtggtgatcatcctgatcctgatctacatcctgatgcccatcttcagactgatcagaaccttcctgatcaagaacgagatcgagtacaccaccgagcagaagatgagatga

SEQ ID NO: 9420 - RNA, 4257 nt, synthetic construct
  misc_feature 1..4257: note = derived and/or modified CDS sequence (opt4) from OROV/MDDV(FMD 1303)__KF697145.1__GP
  source 1..4257: mol_type = other RNA
atggccttcctgctgatctacgtggtgctggccgccgccgtggccagccaccccctgagcaaccaccagatcggcgacagatgcttcgccggcggcaacctgatcagagagctgaacaagaccgtgaacatcggcgagctgtgcgtgagagacgacatcagcatgatcaagagcaccaccgccatccagaagagcgtgggccacctgagcaccagaaccaagttctacagagtgtacatcgtgaaggagtgggccgagtgcaaccccatcatcgacttcgccggcaacttcatcatcatgaacatcgacgagaacggccacctggtgcccaagatgcacacctgcagagccagctgcgacatcagactgaacaaggacgacgccgagatcatcctgagcagccagaagaccaaccactacgagatcatcggcaccaccagcatcagcggctggttcaagaacaccatcaacctgcccctggagcacacctgcgagcacatcaccgtgaactgcggccagaagagcctgagattccacgcctgcttcagaatgcacagaggctgcaccagattcttcaagaacacctacatgcccagcaccatgatcgagaccatgtgcgtgaacctggagctgatcatcttcaccctgtacatcttcagcgccgccgtgttcgcctacgtgatcaccaagagctacatcgcctacatcctgctgcccgtgttctaccccatcacctacatcctgggcagcatctacagcagattcaagcagtgcaagacctgcatgctggccgcccaccccttcaccagctgccccaagaagtgcgtgtgcggcagcagattcaactgcaccgaggccctgagagtgcacagactgggcaaggactgccagggctacaagagcctgagcaaggccagacagatgtgcaagagcaagagctggagcttcatcatcgccgtgttcaccggcctgatcctgatggagttcatcacccccatcagcggcgagagaatgtacaagctgagcgagctggccgaggagttcatcgagatgaaggaggaggccagcgccctgaagaaggccatcaacaacctgaagctgctgaacgtgctgctgagcgccatcgccaccctggtggtggtgatggagacctacatcttcaagagcctgttcaacctgctgtacagaagctgcagcatgtgcggcctgatccactacaagatcggcctgagagtgaacctgctgaccaccaacagatgcggcacctgcatctgcggcttcaacgagcagcagagcagcggcttcgagtacgagatcttcctgaaggacatgcacaagcagagagagagctgcaagtacttccccatgctgaaccacttcagaaacgtgaagatcctgaccgtgttcctgctgctgaccatgctgaccgccagcgccagcagcgagtgcctgcagaagcccctgaagatcaagctggaggacctgcacgagtgcatcggcgtgaacttcctgaacagacagtgctacaacagccaggagctgtaccagagcctgaagagcaagaacctggtgagcgaggtggacaagaagtacttcgacaacaagaacctggaggacctgttcaagagaatcgagtacgcccaggacgcccacagaatgatcctgctggagagaatcctgtacagcaccgagtgcgagatgcacaccatcctgaccaacggcggcgcctacaacatcccctggagaacctacctgaagaaccacaacctgaacctgtgcggcaagcacgtgcacaagatggtgtgccagtgcatcaacacccacacccagtgcctgagcaccggcatcgactaccaggacgagatcaccaagttctaccaggccgacggcgacagctacagagccgacctgagcgtgatcctgcagaccatcgccaccgccttcagaggcatgaccaaggtgctgatcgagacctacatcgagcaggacaacagcgagagcatgatcaagctgctgaacaccatcaaggagaaggtgcccaacaactaccagatgctgggcatcctgaacttcgccatcaagatcatgagcgtgaaccagaccagaggcgtgagaagcgccagacacaccatcatcagcaacgacatccccatgagcgagaccttcagcaacttcgaggtgagcaacatcgacgtgaagcagtgcaccgaccccctgaccctgaagtgcttcaccaagagaggcgacgccccccacagcaaccacctgctgtgcaaggagcagaacaagtacaaggtgttcgagtggcccgagatcgagaccgtgatgaagaacaacaagctgtgcctgggcgacacccactgcaacctgaagttcgccgccatcgccagcgacgaggtgatcaagctgctgaactgcttcagcgacacctacaagcccaaccccggcgagatggaggtgggcgccaagaagtgcaacgccgacaagatcggcgagtgcatcaccctggagaacaacccctggcccatcgtgtactgcgagaccaagtactactacagcgacgccaaggagcacgccaaggacggcaacgtgaacagctactgcctgaccaacaagtgcaacgaggacagattccccatcaaccccacctggttcaagagctgcagctgggacagaaacgtgaaggagaccaccaccatcaaggagttcgtgcacaacgacatcagcgcctacagaaagagcctggagagcgagatcagcaccgacctgctgatccaccactacagacccaccaagaacctgccccacatcatgcccgcctacaagagcctgaccatccagggcagcgagaccgtggacggcctgcagaacagcttcatcgagggcgagatgcccgccatcagcggcctggccaacggctaccacctgaagtacaagggcatcgagctgttcgacatcgtgatcttcatcagaaaggccgtgtacaaggccaactactacaagatctacaccaccggccccagcgtggccatcaacatggagcacaacgagcagtgcaccggcagctgccccaagaagatccccgccaaggagaactggctgaccttcagcaaggagcacaccagcagctggggctgcgaggagtacggctgcctggccatcgacaccggctgcctgtacggcagctgccaggacgtgatcagacccgaggtggacgtgtacaagaaggccagcgccgagcagagcctgatcgagctgtgcatcaccagcgcccacgagaccttctgcaacgacctggacatcctggagcccatcatcggcgacaagatcagcgccgccttccagagcacccaggtgaaccagctgcccaacatcatcgccttcaagaagggccagatcttcaccggcgccatcaacgacctgggcaacaccggcagccagtgcggcagcatccagctgatcaacaacaccctgctgggcgagggcaacgtgaagttcgactacatctgccacgccatgaagagaaaggacgtgatcgtgagaagatgctacaacgaccacttcgccagctgcaacctgctgcagaagagaagcgacctggtgggcaccctgaacggcaaggagctgcaggtgagcatgagcggcagaagcatgggcagcatgaagttcaaggtggagctgggcgacatcagctacaagctgtacaccgagaacgccgacatcagcatcagcggcgagtgcggcggctgcatcaactgcgccgaggccatcagctgcgccctggagatcgacagcagcaccgaggtgctgtgcaagctggagtgcagctgccagccctacatccagaacatcctgatcaagccccaggtgaagaagtacagcttcaaggccacctgcttcgagaagagaaacagcctggaggtgaccgtgtgcaagaagcagcacaccatccccctgaccatcaagagctacaaccagaagatcgacctgagcagactggacgagagcaactacgtgagagaggaggacctgacctgcaacacctggctgtgcaaggtggagaaggagggcatcggcgtgatgttcagcggcctgttcgccggcttcggcaagtactggagcatcgccatctacgccctgatcgccctggtgatcttcctgatcctgatctacatcctggtgcccatcttcagactgatcagaaccttcctgatcaagaacgaggtggagtacaccaccgagcagaagatgagatga

SEQ ID NO: 9421 - RNA, 4257 nt, synthetic construct
  misc_feature 1..4257: note = derived and/or modified CDS sequence (opt4) from OROV/MDDV(INHRR 17a-10)__KJ866390.1__GP
  source 1..4257: mol_type = other RNA
atggccttcctgctgatctacgtggtgctggccgccaccgtggccagccaccccctgagcaaccaccagatcggcgacagatgcttcgccggcggcaacctgatcagagagctgaacaagaccgtgaacatcggcgagctgtgcgtgagagacgacatcagcatgatcaagagcaccaccgccatccagaagagcgtgggccacctgagcaccagaaccaagttctacagagtgtacatcgtgaaggagtgggccgagtgcaaccccatcatcgacttcgccggcaacttcatcatcatgaacatcgacgagaacggccacctggtgcccaagatgcacacctgcagagccagctgcgacatcagactgaacaaggacgacgccgagatcatcctgagcagccagaagaccaaccactacgagatcatcggcaccaccagcatcagcggctggttcaagaacaccatcaacctgcccctggagcacacctgcgagcacatcaccgtgaactgcggccagaagagcctgagattccacgcctgcttcagaatgcacagaggctgcaccagattcttcaagaacacctacatgcccagcaccatgatcgagaccatgtgcgtgaacctggagctgatcatcttcaccctgtacatcttcagcgccgccgtgttcgcctacgtgatcaccaagagctacatcgcctacatcctgctgcccgtgttctaccccatcacctacatcctgggcagcatctacagcagattcaagcagtgcaagacctgcatgctggccgcccaccccttcaccagctgccccaagaagtgcgtgtgcggcagcagattcaactgcaccgaggccctgagagtgcacagactgggcaaggactgccagggctacaagagcctgagcaaggccagacagatgtgcaagagcaagagctggagcttcatcatcgccgtgttcaccggcctgatcctgatggagttcatcacccccatcagcggcgagagaatgtacaagctgagcgagctggccgaggagttcatcgagatgaaggaggaggccagcgccctgaagaaggccatcaacaacctgaagctgctgaacgtgctgctgagcgccatcgccaccctggtggtggtgatggagacctgcatcttcaagagcctgttcaacctgctgtacagaagctgcagcatgtgcggcctgatccactacaagatcggcctgagagtgaacctgctgaccaccaacagatgcggcacctgcatctgcggcttcagcgagcagcagagcagcggcttcgagtacgagatcttcctgaaggacatgcacaagcagagagagagctgcaagtacttccccatgctgaaccacttcagaaacgtgaagatcctgaccgtgttcctgctgctgaccatgctgaccgccagcgccagcagcgagtgcctgcagaagcccctgaagatcaagctggaggacctgcacgagtgcatcggcgtgaacttcctgaacagacagtgctacaacagccaggagctgtaccagagcctgaagagcaagaacctggtgagcgaggtggacaagaagtacttcgacaacaagaacctggaggacctgttcaagagaatcgagtacgcccaggacgcccacagaatgatcctgctggagagaatcctgtacagcaccgagtgcgagatgcacaccatcctgaccaacggcggcgcctacaacatcccctggagaacctacctgaagaaccacaacctgaacctgtgcggcaagcacgtgcacaagatggtgtgccagtgcatcaacacccacacccagtgcctgagcaccggcatcgactaccaggacgagatcaccaagttctaccaggccgacggcgacagctacagagccgacctgagcatcatcctggagaccatcgccaccgccttcagaggcatgaccaaggtgctgatcgagacctacatcgagcaggacaacagcgagagcatgatcaagctgctgaacaccatcaaggagaaggtgcccaacaactaccagatgctgggcatcctgaacttcgccatcaagatcatgagcgtgaaccagaccagaggcgtgagaagcgccagacacaccatcatcagcaacgacatccccatgagcgagaccttcaccaacttcgaggtgagcaacatcgacgtgaagcagtgcaccgaccccctgaccctgaagtgcttcaccaagagaggcgacgccccccacagcaaccacctgctgtgcaaggagcagaacaagtacaaggtgttcgagtggcccgagatcgagaccgtgatgaagaacaacaagctgtgcctgggcgacacccactgcaacctgaagttcgccgccatcgccagcgacgaggtgatcaagctgctgaactgcttcagcgacacctacaagcccaaccccggcgagatggaggtgggcaccaagaagtgcaacgccgacaagatcggcgagtgcatcaccctggagaacaacccctggcccatcgtgtactgcgagaccaagtactactacagcgacgccaaggagcacgccaaggacggcaacgtgaacagctactgcctgaccaacaagtgcaacgaggacagattccccatcaaccccacctggttcaagagctgcagctgggacagaaacgtgaaggagaccaccaccatcaaggagttcgtgcacaacgacatcagcgcctacagaaagagcctggagagcgagatcagcaccgacctgctgatccaccactacagacccaccaagaacctgccccacatcatgcccgcctacaagagcctgaccatccagggcagcgagaccgtggacggcctgcagaacagcttcatcgagggcgacatgcccgccatcagcggcctggccaacggctaccacctgaagtacaagggcatcgagctgttcgacatcgtgatcttcatcaagaaggccgtgtacaaggccaactactacaagatctacaccaccggccccagcgtggccatcaacatggagcacaacgagcagtgcaccggcagctgccccaagaagatccccgccaaggagaactggctgaccttcagcaaggagcacaccagcagctggggctgcgaggagtacggctgcctggccatcgacaccggctgcctgtacggcagctgccaggacgtgatcagacccgagatcgacgtgtacaagaaggccagcgccgagcagagcctgatcgagctgtgcatcaccagcgcccacgagaccttctgcaacgacctggacatcctggagcccatcatcggcgacaagatcagcgccgccttccagagcacccaggtgaaccagctgcccaacatcatcgccttcaagaagggccagatcttcaccggcgccatcaacgacctgggcaacaccggcagccagtgcggcagcatccagctgatcaacaacaccctgctgggcgagggcaacgtgaagttcgactacatctgccacgccatgaagagaaaggacgtgatcgtgagaagatgctacaacgaccacttcgccagctgcaacctgctgcagaagagaagcgacctggtgggcaccctgaacggcaaggagctgcaggtgagcatgagcggcagaagcatgggcagcatgaagttcaaggtggagctgggcgacatcagctacaagctgtacaccgagaacgccgacatcagcatcagcggcgagtgcggcggctgcatcaactgcgccgaggccatcagctgcgccctggagatcgacagcagcaccgaggtgctgtgcaagctggagtgcagctgccagccctacatccagaacatcctgatcaagccccaggtgaagaagtacagcttcaaggccacctgcttcgagaagagaaacagcctggaggtgaccgtgtgcaagaagcagcacaccatccccctgaccatcaagagctacaaccagaagatcgacctgagcagactggacgagagcaactacgtgagagaggaggacctgacctgcaacacctggctgtgcaaggtggagaaggagggcatcggcgtgatgttcagcggcctgttcgccggcttcggcaagtactggagcatcgccatctacgccctgatcgccctggtgatcttcctgatcctgatctacatcctggtgcccatcttcagactgatcagaaccttcctgatcaagaacgaggtggagtacaccaccgagcagaagatgagatga

SEQ ID NO: 9422 - RNA, 4257 nt, synthetic construct
  misc_feature 1..4257: note = derived and/or modified CDS sequence (opt4) from OROV/Perdoes virus(BeAn789726)__KP691625.1__GP
  source 1..4257: mol_type = other RNA
atgttcatccagttcaacctggccttcttctgcctgagcatcgtgtgcggccaccccctgaccaaggaccacatcggcgacagatgcttcgccggcggcaacctgttcaaggagatcacccagaccaccggcctgagcgagatctgcatcaaggacgacatcagcatcatcaagagccaggtggagatcaagaagcagagcagcgaggtgacctacgccgtgaagttctacagagtgtacctggtgaaggagtggagcgagtgcaaccccatccaggaccagcacggcagcatcatgatcctggacgtgaccaacaccggcctgatcgtgcccaagatgtacacctgcagagccgcctgcgacatcaccctggacaaggacaacgccgaggtggtgttcatcagccagaagaacaacaactacgagctggccggcaccaccgtgatgcacggctggttcaagaacgtggtgagcatcaagctggagcacacctgcgagcacctgaccgccacctgcggccagaagaccgtgaagttccacgcctgcttcagacagcacagagcctgcgccagattcctgaagaccacctacatgcccatcgtgatggtggagagcctgtgcagcaacctggagctggtgatcttcatcacctacatcttcgtgtgcctggccttcgccttcatcatcaccagaacctacgtggcctacctgctgatccccgtgttctaccccttcacctacgcctacggcaagatgtacctgaagtgcgtgaagacctgccccaactgcctgctggccatgcaccccttcaccaactgcaccaacctgtgcatctgcggcagcagattcagcaacaccgagagcctgaaggtgcacagactgggcaactgctacggctacaaggccctgagcggcgccagaagcatgtgcaagagcaaggtgagcagcttcaccaccgccatgttcttcggcatcatcatcctgagcttcatcgcccccctgaacggcgagagactgtacaagctgagcgagctgcccgacgagtacatcgagatggagagcaccatcgagggcagcaagcagaaggagaccatcgtggacatcatcaactacaccgccctggtgctgatcctgatcaccatcctgctgcagggcatcctggagaactacatcttcagactgaagttcagattctgcagcttctgcgacatgatccacatgaagaagaacctgaagatcttcagcaacatgaccaacaagtgcggcacctgcatctgcggcttcaaccaggagatcagaagcggcttcgactacgaggtgttcatcaaggacatgcacgtgagcagagagagctgcaagtacaactaccacaagaactacagcttctacatcaagatgctgctggtggtgctgctggtgcccctgatcggcaccaccgccgccgaggacaccaagtgcctgaagtacgacctgaacaagaacatcgaggacctgaaggactgctacggcctgaagctgaacatcgacaagcacgacaccgtggagaacgcctacaagaacctggtggaccagaagctggtgagcgagctggacagactggacctgaacatcatgctgggcagcaaggagagcatcttcgaggccatcgagaccagcatgaacatccaccagatggtgttcctggagtacctggcctacaagaccgaccccaagctgagcgagatcaagcagaacaccggcccctacaacatcgcctggagaaccttcatccacggcaacagcctggaggtgtgcggcaactacccctacaagctgatctgctactgcatcaaccagaagacccactgcgagaacagcaccgtggactacggcatccagatccagcccttctacaaccagcaccccaacagctacaagagcgacatggaggccctgatcaagaccgtgcagatcgccttcagaggcatcatcaaggtgctgatccagtactacgtggagaacaacaagaccagcgagctgagcaacctgctgaccgagctgagaaacgtgatgggcaacaacatccagatgaagggcatcctgaagtacctggagacctacctgaagaagcccctgctgatggccagaaccatcagaatcgccgccaaggtggacaccagcggcgacccctacaacaacttcagcaccagcaaggagaacatcaccaagtgcatcaagatccagaagctgagatgcatcaccaagctgaccagaatcgagcacaactacatcctgtgcggcgacagcgagaagaagctgtaccagtggcccgccaagcccaccatcgtggacgacaacgacgcctgcctgggcgacaagcactgccacctgcccttcatccccatcggcaacgacgaggccatcaagaccgtgaactgctacgtggaggtgtacgagcagaaccccggcgacatgaacagctaccagaagaagtgcgacgccatgaacgtgggcacctgcctgaccatcaagaacgagaactggcccatcgtgcagtgcaagaccggcaagtactactacgccgacggcagaatccacgccaaggacggcaccatcaacacctactgcttcagcgagaagtgcaacgccgacagataccccatccaccaggactacatcaacagctgcaactggcaggagaccatcaaggacttccagcacgtgagagagttcgtgcacctggacatcgagagctacaagaaggccatcgagagcgacatcaagaccgacctggtggtgcacaagttcagacccgtgaagaacctgccccacgtgatccccatctacaagagcatcaccgtgcagggcaccgagaccagcgacggcatccagaacgccttcatccagggcagcatgcccgccatcagcggcctggccaacggctaccacctgttcacccccgacagcaagcagctgttcgacgtggtgctgttcctgagaaaggccagctacaaggccgagtacagaaagatctacagcaccggccccaccatcggcatcaacgtggagcacaacgagaagtgcaccggcagctgccccaagaccatcgacaagaaggacaactggctgaccttcagcaaggagcacaccagccagtggggctgcgaggagtacggctgcctggccatcaacaccggctgcgtgttcggcagctgccaggacatcatcagacccgagatcgacgtgtacaagatgcacggcgccgagagaagcgtggtggagctgtgcatcaccctgccccacgagacctactgcaacgacctggacgtgctggagcccatcatcggcgacaagatccaggccgccttccagaccgtgcagagcaaccacatgcccagactgatggccatcaagaacaacaaggccttcaccggccagatcaacgacctgggcagcaccgccagctactgcggcagcgtgcagaagttcaacgagaccatcatcggccagggcgaccccaagttcgactacgtgtgccacctgctgaagagaaaggacatcatcgtgagaagatgctacagcaacaactacgagagctgcaagctgctgacccccagagccgacatcatcgtggacaagaagggcgagagcctgcaggccagcatcgtgggcctgaacctgggccagatgaacttcaagatcatgctgggcgacatcaactacaagcagtacaccgagagcaacaacctggaggccaccggccagtgcgtgggctgcgtggactgcagcgaggacatcgtgtgcaacctgaagatcgagagccagagcgagagcgtgtgcaacatcaagagcgactgcaacctgtacctgagcagcatgctgatccagcccaccgtgggcgagtacaacctgaagatgagctgcaacgccaagctggacaaggtgaacatcgagatctgcaagcagaagttcgtgctgcccctgaccatcaagagccacaaccagaagatcgacctgagcaagctggacgagagcaactacatcagagaggaggacctgaagtgcgacaccatgatctgcaaggtgaaggacgagggcctgagcttcatcaccaacagcctgttcggcggcatcagctacttctggaagatcctgatcagcagcctgatcgtgatcttcctgatcatcctgttctactacgtgggcctgcccatcctgagactgatcaaggactacctgaaggagaacgagctggagtacctggccgagggcaagtga

SEQ ID NO: 9423 - RNA, 4257 nt, synthetic construct
  misc_feature 1..4257: note = derived and/or modified CDS sequence (opt4) from OROV/Perdoes virus(BeAn790177)__KP691628.1__GP
  source 1..4257: mol_type = other RNA
atgttcatccagttcaacctggccttcttctgcctgagcatcgtgtgcggccaccccctgaccaaggaccacatcggcgacagatgcttcgccggcggcaacctgttcaaggagatcacccagaccaccggcctgagcgagatctgcatcaaggacgacatcagcatcatcaagagccaggtggagatcaagaagcagagcagcgaggtgacctacgccgtgaagttctacagagtgtacctggtgaaggagtggagcgagtgcaaccccatccaggaccagcacggcagcatcatgatcctggacgtgaccaacaccggcctgatcgtgcccaagatgtacacctgcagagccgcctgcgacatcaccctggacaaggacaacgccgaggtggtgttcatcagccagaagaacaacaactacgagctggccggcaccaccgtgatgcacggctggttcaagaacgtggtgagcatcaagctggagcacacctgcgagcacctgaccgccacctgcggccagaagaccgtgaagttccacgcctgcttcagacagcacagagcctgcgccagattcctgaagaccacctacatgcccatcgtgatggtggagagcctgtgcagcaacctggagctggtgatcttcatcacctacatcttcgtgtgcctggccttcgccttcatcatcaccagaacctacgtggcctacctgctgatccccgtgttctaccccttcacctacgcctacggcaagatgtacctgaagtgcgtgaagacctgccccaactgcctgctggccatgcaccccttcaccaactgcaccaacctgtgcatctgcggcagcagattcagcaacaccgagagcctgaaggtgcacagactgggcaactgctacggctacaaggccctgagcggcgccagaagcatgtgcaagagcaaggtgagcagcttcaccaccgccatgttcttcggcatcatcatcctgagcttcatcgcccccctgaacggcgagagactgtacaagctgagcgagctgcccgacgagtacatcgagatggagagcaccatcgagggcagcaagcagaaggagaccatcgtggacatcatcaactacaccgccctggtgctgatcctgatcaccatcctgctgcagggcatcctggagaactacatcttcagactgaagttcagattctgcagcttctgcgacatgatccacatgaagaagaacctgaagatcttcagcaacatgaccaacaagtgcggcacctgcatctgcggcttcaaccaggagatcagaagcggcttcgactacgaggtgttcatcaaggacatgcacgtgagcagagagagctgcaagtacaactaccacaagaactacagcttctacatcaagatgctgctggtggtgctgctggtgcccctgatcggcaccaccgccgccgaggacaccaagtgcctgaagtacgacctgaacaagaacatcgaggacctgaaggactgctacggcctgaagctgaacatcgacaagcacgacaccgtggagaacgcctacaagaacctggtggaccagaagctggtgagcgagctggacagactggacctgaacatcatgctgggcagcaaggagagcatcttcgaggccatcgagaccagcatgaacatccaccagatggtgttcctggagtacctggcctacaagaccgaccccaagctgagcgagatcaagcagaacaccggcccctacaacatcgcctggagaaccttcatccacggcaacagcctggaggtgtgcggcaactacccctacaagctgatctgctactgcatcaagcagaagacccactgcgagaacagcaccgtggactacggcatccagatccagcccttctacaaccagcaccccaacagctacaagagcgacatggaggccctgatcaagaccgtgcagatcgccttcagaggcatcatcaaggtgctgatccagtactacgtggagaacaacaagaccagcgagctgagcaacctgctgaccgagctgagaaacgtgatgggcaacaacatccagatgaagggcatcctgaagtacctggagacctacctgaagaagcccctgctgatggccagaaccatcagaatcgccgccaaggtggacaccagcggcgacccctacaacaacttcagcaccagcaaggagaacatcaccaagtgcatcaagatccagaagctgagatgcatcaccaagctgaccagaatcgagcacaactacatcctgtgcggcgacagcgagaagaagctgtaccagtggcccgccaagcccaccatcgtggacgacaacgacgcctgcctgggcgacaagcactgccacctgcccttcatccccatcggcaacgacgaggccatcaagaccgtgaactgctacgtggaggtgtacgagcagaaccccggcgacatgaacagctaccagaagaagtgcgacgccatgaacgtgggcacctgcctgaccatcaagaacgagaactggcccatcgtgcagtgcaagaccggcaagtactactacgccgacggcagaatccacgccaaggacggcaccatcaacacctactgcttcagcgagaagtgcaacgccgacagataccccatccaccaggactacatcaacagctgcaactggcaggagaccatcaaggacttccagcacgtgagagagttcgtgcacctggacatcgagagctacaagaaggccatcgagagcgacatcaagaccgacctggtggtgcacaagttcagacccgtgaagaacctgccccacgtgatccccatctacaagagcatcaccgtgcagggcaccgagaccagcgacggcatccagaacgccttcatccagggcagcatgcccgccatcagcggcctggccaacggctaccacctgttcacccccgacagcaagcagctgttcgacgtggtgctgttcctgagaaaggccagctacaaggccgagtacagaaagatctacagcaccggccccaccatcggcatcaacgtggagcacaacgagaagtgcaccggcagctgccccaagaccatcgacaagaaggacaactggctgaccttcagcaaggagcacaccagccagtggggctgcgaggagtacggctgcctggccatcaacaccggctgcgtgttcggcagctgccaggacatcatcagacccgagatcgacgtgtacaagatgcacggcgccgagagaagcgtggtggagctgtgcatcaccctgccccacgagacctactgcaacgacctggacgtgctggagcccatcatcggcgacaagatccaggccgccttccagaccgtgcagagcaaccacatgcccagactgatggccatcaagaacaacaaggccttcaccggccagatcaacgacctgggcagcaccgccagctactgcggcagcgtgcagaagttcaacgagaccatcatcggccagggcgaccccaagttcgactacgtgtgccacctgctgaagagaaaggacatcatcgtgagaagatgctacagcaacaactacgagagctgcaagctgctgacccccagagccgacatcatcgtggacaagaagggcgagagcctgcaggccagcatcgtgggcctgaacctgggccagatgaacttcaagatcatgctgggcgacatcaactacaagcagtacaccgagagcaacaacctggaggccaccggccagtgcgtgggctgcgtggactgcagcgaggacatcgtgtgcaacctgaagatcgagagccagagcgagagcgtgtgcaacatcaagagcgactgcaacctgtacctgagcagcatgctgatccagcccaccgtgggcgagtacaacctgaagatgagctgcaacgccaagctggacaaggtgaacatcgagatctgcaagcagaagttcgtgctgcccctgaccatcaagagccacaaccagaagatcgacctgagcaagctggacgagagcaactacatcagagaggaggacctgaagtgcgacaccatgatctgcaaggtgaaggacgagggcctgagcttcatcaccaacagcctgttcggcggcatcagctacttctggaagatcctgatcagcagcctgatcgtgatcttcctgatcatcctgttctactacgtgggcctgcccatcctgagactgatcaaggactacctgaaggagaacgagctggagtacctggccgagggcaagtga

SEQ ID NO: 9424 - RNA, 4284 nt, synthetic construct
  misc_feature 1..4284: note = derived and/or modified CDS sequence (opt4) from OROV/UTIV(BeAn84785)__KF697155.1__GP
  source 1..4284: mol_type = other RNA
atgttcctgatcttcatcctgatccagatcgccgccagcacccccctgagcccccagcaggtgggcgacagatgcttcatcggcggcagcctgatcaaggagatcaaccagagcaccggcctgggcgaggtgtgcatcaaggacgacatcagcatcatcaagagcatcaacatccagaagaagatcagcaacgaccaggtgcagaacaccgtgaagttctacaagacctacatcgccagagagtggcacgactgcaaccccatcttcgacgagcacggcagcttcatggtgttcgacatcagcaacaccggcagcatcatccccaagatgcacacctgcagagcccagtgcgagatcaccctgaacaaggacaacgccgaggtgatcttcaccagcgccaagaccaaccactacgaggtgagcggcaccaccaccgtgaacggctggttcaagcagaccatcagcgtgagcctggagcacacctgcgagcacatcatcgccagctgcggccagaagagcctgaagttccacgcctgcttcagacagcacagaagctgcgtgagattcttcagaaacagctacctgccctacaagatgatcgagagcctgtgcatcaacatcgagctgatcatcatcctgtgctacgccctgctgtgcttcatcttcgcctacatcatcaccaagacctacatcgcctacctgctgatccccctgttctaccccatcacctacatctacggcaagatctacaacaagtacttcaagagatgcaagagctgcctgctggccgtgcaccccctgaccaactgcaacaagacctgcgtgtgcggctgcagattcaacagcaccgaggccctgaaggtgcacagactgggcaaggactgcaacggcttcaaggccctgagcaaggccagattcctgtgcaagagcaccggccccagcttcaccatctgcttcctgaccggcatgctgatcctgagcttcatcacccccatcaacagcgagaagctgtacaagctggaggagctgcccgacgactacatcaacctggagaaccagctgagcgagtgcaacaacaacaagcagatcaccagagccctggccgtggcctgcatcctgggcaacatcctgttcgtgctgttcttcaagttcatctacaacaagctgatcaacaacatctacagaacctgcaacctgtgcaacatggtgcaccacagaaagaacctgaagatctacagcgagttcaccaacaagtgcggcacctgcgtgtgcggcttcaacgaggagatcagaagcggcttcgactacgaggtgttcatcaaggacatgcacatcttcagagacaactgcctgttcaagttctacagcaagtacagcatcatctacatctgcatcatcatcctggtgatcaacctgcagctgggcatgaccctggccgaggagaccgagaccaactgcctgaacctgcccatcagcgcccagaccctggacatcgtgaagtgctacggcctgaacctgaacatcaccgagaacaagcagaagagcgacctgatcagcgagctgaagagccagaagaccatcaccgaccacgacatccccgacttcaacatcatcgacatgaagaccgagagcgccttcgagaagatcgagaccgccgagaacatccacagaatggccttcctggagtacatcctgtacaagatggagagcaagctgaacaccatcaagaccaacagcggcccctacaacgtggcctggagaacctacatcaagtaccacaacctggacgcctgcggcaagtacccccacaagaccatctgcacctgcatcaacgcccacctgagctgcagccagcccaccgtggacagcaacagcgagatcaagaccttctacagcaaccaccagagcgccttcaagaacgacatcaacgtgctgatcgagaccatcagcatcgccttcagaggcatcatcaaggtgagcatcaacctgctgctgaagaacaacaagatcgacgagctgaaggagctgctgaccaacatcagcaagaagctggacaccaacatccagatgaagggcatcctgctgttcaccgccgagcagctgaagacccaggagaccaccgtgaagagcatgcagcagaccagaatggccatcatcgtgaagcccctggagagcatgaccggcgacaagttcgacaacttcagcaccaccaacagaaacatcaccaagtgcaaggaggccaagagcctgagctgctacatgaccagaaagaacagcatcaacaagtacctgctgtgcaacctggacggctacaagatcttcagctggcccgagaagcccaccctgagcatcaacaacaacatctgcatcggcgacagccactgcaacctgtacttcaagcccatcctgaacgacgaggccatcaagaccatcaactgctacaagggcgacttcacccccaaccccatggacatgggcagcgccatcaagaagtgcgaggccaaggagatcggcgactgcctggtgggcgacaacaacatgtggcccatcatccagtgcagcaacgagaagtactactacgccgacggcaagaaccacgccaaggagggcgacatcaacagctactgcctgagcgagaagtgcaacaccgacagattccccatccacaacgagtggttcaagagctgcaagtggatcagcaccatcaaggagagcatcagcgtgaaggagttcgtgcacctggacatcgagagctacaagaagggcatcgagagcgacatcagaaccgacctgatcatccacaagttcagacccgtgaagaacctgccccacatcgcccccaagtacaagagcatcaccatcagcggcatcctggtggccgacggcatccagaacgccttcgtgagcggcgagatgcccgccatcagcggcctgggcatcggctacaacctgtacagccccgacggcaccaagctgttcgacatcgtgctgttcctgagaaaggccatctacaagagcagctacaagctgatctacaagaccggccccaccatcggcatcaacgtggagcacaacgagcagtgcaccggcagctgccccagcaccatccccaagcaggagggctggctgaccttcagcaaggagcacaccagccagtggggctgcgaggagttcggctgcctggccatcgacaccggctgcctgtacggcagctgccaggacatcatcagacccgagatgagcatctacaagatgctgggcgaggagatgaccagcatcgagatctgcctgaccacccccaaggagacctactgcaacgacctggacctgctggagcccctgatcggcgacaagatcgaggtgagcttccagaccgtgcagagcagccacatgcccaagatcatcgccgtgaagaacaacaaggtgtacaccggccagatcaacgacatcggcaacaccgccaacatctgcggcagcgtgcagatcatcaacaagaccgtgatcggccagggcaaccccaagttcgactacctgtgccacgccatgaagagaaaggacgtgatcgtgagaaagtgctacgacaaccacttcgagacctgcaagctgctggaggagagaagcgagatcctgatcaaccagcagagcgacaccatcgccgccagcatgagcggcaagaacctgggcatcatgaacttcaagttcgccctgggcgacatcgactacaagaccttcaccgaggacgccagcttcgacatcaagggccagtgcgtgggctgcatcaactgcatcgaggagatcgtgtgcgagctgaacatcgtgagcaccagcagcatcctgtgcaccatcaagaccccctgcgagaactaccacaacagcctggagatcaaccccgccaccaccaagtaccacatcaagatgagctgcccccacaacatcgacaagatgaagatcaccatctgcagcaaggacctggagatgcccctgaccctgaagcagcacgaccagaagatcgacctgagcaagctggacgagagcaactacatcaaggaggaggacctgagatgcagcacctggctgtgcaaggtgaaggaggagggcatcggcttcatcttcagcggcatcttcggcaacttcggcaagtactggaccatcttcctgatcgtgctggtgatcctggccaccggcctgctgggcatcttcgtgatctacccctgctgcaagagactgagaggcttcctggagatcaacgacatcgcctacctggccgagcagaagatgaagtga

SEQ ID NO: 9425 - RNA, 3231 nt, synthetic construct
  misc_feature 1..3231: note = derived and/or modified CDS sequence (opt4) from HRTV(TN)__KJ740147.1__GP
  source 1..3231: mol_type = other RNA
atgatcgtgcccatcgtgctgttcctgaccctgtgccccagcgagctgagcgcctggggcagccccggcgaccccatcgtgtgcggcgtgagaaccgagaccaacaagagcatccagatcgagtggaaggagggcagaagcgagaagctgtgccagatcgacagactgggccacgtgaccagctggctgagaaaccacagcagcttccagggcctggtgggccaggtgaagggcagacccagcgtgagctacttccccgagggcgccagctaccccagatggagcggcctgctgagcccctgcgacgccgagtggctgggcatgatcgccgtgagcaaggccggcgacaccgacatgatcgtgcccggccccacctacaagggcaagatcttcgtggagagacccacctacaacggctacaagggctggggctgcgccgacggcaagagcctgagccacagcggcacctactgcgagaccgacagcagcgtgagcagcggcctgatccagggcgacagagtgctgtgggtgggcgaggtggtgtgccagagaggcacccccgtgcccgaggacgtgttcagcgagctggtgagcctgagccagagcgagttccccgacgtgtgcaagatcgacggcgtggccctgaaccagtgcgagcaggagagcatcccccagcccctggacgtggcctggatcgacgtgggcagaagccacaaggtgctgatgagagagcacaagaccaagtgggtgcaggagagcagcgccaaggacttcgtgtgcttcaaggtgggccagggcccctgcagcaagcaggaggaggacgactgcatgagcaagggcaactgccacggcgacgaggtgttctgcagaatggccggctgcagcgccagaatgcaggacaaccaggagggctgcagatgcgagctgctgcagaagcccggcgagatcatcgtgaactacggcggcgtgagcgtgagacccacctgctacggcttcagcagaatgatggccaccctggaggtgcacaagcccgacagagagctgaccggctgcaccggctgccacctggagtgcatcgagggcggcgtgaagatcgtgaccctgaccagcgagctgagaagcgccaccgtgtgcgccagccacttctgcgccagcgccaagggcggcagcaagaccaccgacatcctgttccacaccggcgccctggtgggccccaacagcatcagaatcaccggccagctgctggacggcagcaagttcagcttcgacggccactgcatcttccccgacggctgcatggccctggactgcaccttctgcaaggagttcctgagaaacccccagtgctaccccgtgaagaagtggctgttcctggtggtggtgatcatgtgctgctactgcgccctgatgctgctgaccaacatcctgagagccatcggcgtgtggggcacctgggtgttcgcccccatcaagctggccctggccctgggcctgagactggccaagctgagcaagaagggcctggtggccgtggtgaccagaggccagatgatcgtgaacgacgagctgcaccagatcagagtggagagaggcgagcagaacgagggcagacagggctacggccccagaggccccatcagacactggctgtacagccccgccctgatcctgatcctgaccaccagcatctgcagcggctgcgacgagctggtgcacgccgagagcaagagcatcacctgcaagagcgccagcggcaacgagaaggagtgcagcgtgaccggcagagccctgctgcccgccgtgaaccccggccaggaggcctgcctgcacttcagcatgcccggcagccccgacagcaagtgcctgaagatcaaggtgaagagcatcaacctgagatgcaagcaggccagcagctactacgtgcccgaggccaaggccagatgcaccagcgtgagaagatgcagatgggccggcgactgccagagcggctgccccacctacttcagcagcaacagcttcagcgacgactgggccaacagaatggacagagccggcctgggcatgagcggctgcagcgacggctgcggcggcgccgcctgcggctgcttcaacgccgcccccagctgcatcttctggagaaagtgggtggagaaccccagcaacagagtgtggaaggtgagcccctgcgccagctgggtgctggccgccaccatcgagctgaccctgcccagcggcgaggtgaagaccctggagcccgtgaccggccaggccacccagatgttcaagggcgtggccatcacctacctgggcagcagcatcgagatcgtgggcatgaccagactgtgcgagatgaaggagatgggcaccggcatcatggccctggccccctgcaacgaccccggccacgccatcatgggcaacgtgggcgagatccagtgcagcagcatcgagagcgccaagcacatcagaagcgacggctgcatctggaacgccgacctggtgggcatcgagctgagagtggacgacgccgtgtgcttcagcaagctgaccagcgtggaggccgtggccaacttcagcaagatccccgccaccatcagcggcgtgagattcgaccagggcaaccacggcgagagcagaatctacggcagccccctggacatcaccagagtgagcggcgagttcagcgtgagcttcagaggcatgagactgaagctgagcgagatcagcgccagctgcaccggcgagatcaccaacgtgagcggctgctacagctgcatgaccggcgccagcgtgagcatcaagctgcacagcagcaagaacaccaccggccacctgaagtgcgacagcgacgagaccgccttcagcgtgatggagggcacccacacctacagaccccacatgagcttcgacaaggccgtgatcgacgaggagtgcgtgctgaactgcggcggccacagcagcaagctgctgctgaagggcagcctggtgttcatggacgtgcccagattcgtggacggcagctacgtgcagacctaccacagcaaggtgcccgccggcggcagagtgcccaaccccgtggactggctgaacgccctgttcggcgacggcatcaccagatggatcctgggcatcatcggcgtgctgctggcctgcgtgatgctgttcgtggtggtggtggccatcaccagaagactgatcaagggcctgacccagagagccaaggtggcctga

SEQ ID NO: 9426 - RNA, 3231 nt, synthetic construct
  misc_feature 1..3231: note = derived and/or modified CDS sequence (opt4) from HRTV(Patient2)__JX005844.1__GP
  source 1..3231: mol_type = other RNA
atgatcgtgcccatcgtgctgttcctgaccctgtgccccagcgagctgagcgcctggggcagccccggcgaccccatcgtgtgcggcgtgagaaccgagaccaacaagagcatccagatcgagtggaaggagggcagaagcgagaagctgtgccagatcgacagactgggccacgtgaccagctggctgagaaaccacagcagcttccagggcctgatcggccaggtgaagggcagacccagcgtgagctacttccccgagggcgccagctaccccagatggagcggcctgctgagcccctgcgacgccgagtggctgggcctgatcgccgtgagcaaggccggcgacaccgacatgatcgtgcccggccccacctacaagggcaagatcttcgtggagagacccacctacaacggctacaagggctggggctgcgccgacggcaagagcctgagccacagcggcacctactgcgagaccgacagcagcgtgagcagcggcctgatccagggcgacagagtgctgtgggtgggcgaggtggtgtgccagagaggcacccccgtgcccgaggacgtgttcagcgagctggtgagcctgagccagagcgagttccccgacgtgtgcaagatcgacggcgtggccctgaaccagtgcgagcaggagagcatcccccagcccctggacgtggcctggatcgacgtgggcagaagccacaaggtgctgatgagagagcacaagaccaagtgggtgcaggagagcagcgccaaggacttcgtgtgcttcaaggtgggccagggcccctgcagcaagcaggaggaggacgactgcatgagcaagggcaactgccacggcgacgaggtgttctgcagaatggccggctgcagcgccagaatgcaggacaaccaggagggctgcagatgcgagctgctgcagaagcccggcgagatcatcgtgaactacggcggcgtgagcgtgagacccacctgctacggcttcagcagaatgatggccaccctggaggtgcacaagcccgacagagagctgaccggctgcaccggctgccacctggagtgcatcgagggcggcgtgaagatcgtgaccctgaccagcgagctgagaagcgccaccgtgtgcgccagccacttctgcgccagcgccaagggcggcagcaagaccaccgacatcctgttccacaccggcgccctggtgggccccaacagcatcagaatcaccggccagctgctggacggcagcaagttcagcttcgacggccactgcatcttccccgacggctgcatggccctggactgcaccttctgcaaggagttcctgagaaacccccagtgctaccccgtgaagaagtggctgttcctggtggtggtgatcatgtgctgctactgcgccctgatgctgctgaccaacatcctgagagccatcggcgtgtggggcacctgggtgttcgcccccatcaagctggccctggccctgggcctgagactggccaagctgagcaagaagggcctggtggccgtggtgaccagaggccagatgatcgtgaacgacgagctgcaccaggtgagagtggagagaggcgagcagaacgagggcagacagggctacggccccagaggccccatcagacactggctgtacagccccgccctgatcctgatcctgaccaccagcatctgcagcggctgcgacgagctggtgcacgccgagagcaagagcatcacctgcaagagcgccagcggcaacgagaaggagtgcagcgtgaccggcagagccctgctgcccgccgtgaaccccggccaggaggcctgcctgcacttcagcgtgcccggcagccccgacagcaagtgcctgaagatcaaggtgaagagcatcaacctgagatgcaagcaggccagcagctactacgtgcccgaggccaaggccagatgcaccagcgtgagaagatgcagatgggccggcgactgccagagcggctgccccacctacttcagcagcaacagcttcagcgacgactgggccaacagaatggacagagccggcctgggcatgagcggctgcagcgacggctgcggcggcgccgcctgcggctgcttcaacgccgcccccagctgcatcttctggagaaagtgggtggagaaccccagcaacagagtgtggaaggtgagcccctgcgccagctgggtgctggccgccaccatcgagctgaccctgcccagcggcgaggtgaagaccctggagcccgtgaccggccaggccacccagatgttcaagggcgtggccatcacctacctgggcagcagcatcgagatcgtgggcatgaccagactgtgcgagatgaaggagatgggcaccggcatcatggccctggccccctgcaacgaccccggccacgccatcatgggcaacgtgggcgagatccagtgcagcagcatcgagagcgccaagcacatcagaagcgacggctgcatctggaacgccgacctggtgggcatcgagctgagagtggacgacgccgtgtgcttcagcaagctgaccagcgtggaggccgtggccaacttcagcaagatccccgccaccatcagcggcgtgagattcgaccagggcaaccacggcgagagcagaatctacggcagccccctggacatcaccagagtgagcggcgagttcagcgtgagcttcagaggcatgagactgaagctgagcgagatcagcgccagctgcaccggcgagatcaccaacgtgagcggctgctacagctgcatgaccggcgccagcgtgagcatcaagctgcacagcagcaagaacaccaccggccacctgaagtgcgacagcgacgagaccgccttcagcgtgatggagggcacccacacctacagaccccacatgagcttcgacaaggccgtgatcgacgaggagtgcgtgctgaactgcggcggccacagcagcaagctgctgctgaagggcagcctggtgttcatggacgtgcccagattcgtggacggcagctacgtgcagacctaccacagcaaggtgcccgccggcggcagagtgcccaaccccgtggactggctgaacgccctgttcggcgacggcatcaccagatggatcctgggcatcatcggcgtgctgctggcctgcgtgatgctgttcgtggtggtggtggccatcaccagaagactgatcaagggcctgacccagagagccaaggtggcctga

SEQ ID NO: 9427 - RNA, 3231 nt, synthetic construct
  misc_feature 1..3231: note = derived and/or modified CDS sequence (opt4) from HRTV(Patient1)__JX005845.1__GP
  source 1..3231: mol_type = other RNA
atgatcgcccccgtggtgctgttcttcaccctgtgccccagccagctgagcgcctggggcagccccggcgaccccatcgtgtgcggcgtgagaaccgagaccaacaagagcatccagatcgagtggaaggagggcagaagcgagaagctgtgccagatcgacagactgggccacgtgaccagctggctgagaaaccacagcagcttccagggcctgatcggccaggtgaagggcagacccagcgtgagctacttccccgagggcgccagctaccccagatggagcggcctgctgagcccctgcgacgccgagtggctgggcctgatcgccgtgagcaaggccggcgacaccgacatgatcgtgcccggccccacctacaagggcaagatcttcgtggagagacccacctacaacggctacaagggctggggctgcgccgacggcaagagcctgagccacagcggcacctactgcgagaccgacagcagcgtgagcagcggcctgatccagggcgacagagtgctgtgggtgggcgaggtggtgtgccagagaggcacccccgtgcccgaggacgtgttcagcgagctgatcagcctgagccagagcgagttccccgacgtgtgcaaggtggacggcgtggccctgaaccagtgcgagcaggagagcatcccccagcccctggacgtggcctggatcgacgtgggcagaagccacaaggtgctgatgagagagcacaagaccaagtgggtgcaggagagcagcgccaaggacttcgtgtgcttcaaggtgggccagggcccctgcagcaagcaggaggaggacgactgcatgagcaagggcaactgccacggcgacgaggtgttctgcagaatggccggctgcagcgccagaatgcaggacaaccaggagggctgcagatgcgagctgctgcagaagcccggcgagatcatcgtgaactacggcggcgtgagcgtgagacccacctgctacggcttcagcagaatgatggccaccctggaggtgcacaagcccgacagagagctgaccggctgcaccggctgccacctggagtgcatcgagggcggcgtgaagatcgtgaccctgaccagcgagctgagaagcgccaccgtgtgcgccagccacttctgcgccagcgccaagggcggcagcaagaccaccgacatcctgttccacaccggcgccctggtgggccccaagagcatcagaatcaccggccagctgctggacggcagcaagttcagcttcgacggccactgcatcttccccgacggctgcatggccctggactgcaccttctgcaaggagttcctgagaaacccccagtgctaccccgtgaagaagtggctgttcctggtggtggtggtgatgtgctgctactgcgccctgatgctgctgaccaacatcctgagagccatcggcgtgtggggcacctgggtgttcgcccccatcaagctggtgctggccctgggcctgagactggccaagctgagcaagaagggcctggtggccgtggtgaccagaggccagatgatcgtgaacgacgagctgcaccagatcagagtggagagaggcgagcagaacgagggcagactgggccacggccccagaggccccgtgagacactggctgtacagccccgccctgatcctgatcctgaccaccagcatctgcagcggctgcgacgagctggtgcacgccgagagcaagagcatcacctgcaagagcgccagcggcaacgagaaggagtgcagcgtgaccggcagagccctgctgcccgccgtgaaccccggccaggaggcctgcctgcacttcagcatgcccggcagccccgacagcaagtgcctgaagatcaaggtgaagagcatcaacctgagatgcaagcaggccagcagctactacgtgcccgaggccaaggccagatgcaccagcgtgagaagatgcagatgggccggcgactgccagagcggctgccccacctacttcagcagcaacagcttcagcgacgactgggccaacagaatggacagagccggcctgggcatgagcggctgcagcgacggctgcggcggcgccgcctgcggctgcttcaacgccgcccccagctgcatcttctggagaaagtgggtggagaaccccagcaacagagtgtggaaggtgagcccctgcgccagctgggtgctggccgccatcatcgagctgaccctgcccagcggcgaggtgaagaccctggagcccgtgaccggccaggccacccagatgttcaagggcgtggccatcacctacctgggcagcagcatcgagatcgtgggcatgaccagactgtgcgagatgaaggagatgggcaccggcatcatggccctggccccctgcaacgaccccggccacgccatcatgggcaacgtgggcgagatccagtgcagcagcatcgagagcgccaagcacatcagaagcgacggctgcatctggaacgccgacctggtgggcatcgagctgagagtggacgacgccgtgtgcttcagcaagctgaccagcgtggaggccgtggccaacttcagcaagatccccgccatcatcagcggcgtgagattcgaccagggcaaccacggcgagagcagaatctacggcagccccctggacatcaccaaggtgagcggcgagttcagcgtgagcttcagaggcatgagactgaagctgagcgagatcagcgccagctgcaccggcgagatcaccaacgtgagcggctgctacagctgcatgaccggcgccagcgtgagcatcaagctgcacagcagcaagaacaccaccggccacctgaagtgcgacagcgacgagaccgccttcagcgtgatggagggcacccacacctacagaccccacatgagcttcgacaaggccgtggtggacgaggagtgcgtgctgaactgcggcggccacagcagcaagctgctgctgaagggcagcctggtgttcatggacgtgcccagattcgtggacggcagctacgtgcagacctaccacagcaaggtgcccgccggcggcagagtgcccaaccccgtggactggctgaacgccctgttcggcgacggcatcaccagatggatcctgggcatcatcggcgtgctgctggcctgcgtgctgctgttcgtggtggtggtggccatcaccagaagactgatcaagggcctgacccagagagccaaggtggcctga

SEQ ID NO: 9428 - RNA, 3942 nt, synthetic construct
  misc_feature 1..3942: note = derived and/or modified CDS sequence (opt4) from PTV(PAN472868)__NC_027201.1__GP
  source 1..3942: mol_type = other RNA
atgatcttcaccatcctgaacgtgctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatccagggcgactacatcgtggactgcgtgaccggcctgtaccagagcgacatcggcgtgggcgtgggcctgggcaagacccaccacgaccaccagcaggtgaagaacaaggccgtggtgatcgacgagaaggagagaatgatcagcttcctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatggagaacaacaacaccatccagagaaacaagaacgtgatgagcaccaccgtggtgcccgccatcctgagcgtggccctgctgagcagcagcatcgcccccatcatggccgccagccccgacagccccatgatcaacccctggccccacgccaagaacagagtgggcaccggcatgtacaagtacgacgagaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcatccaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacatcttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgagactgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcagcaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgagaagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9429 - RNA, 3942 nt, synthetic construct
  misc_feature 1..3942: note = derived and/or modified CDS sequence (opt4) from PTV(Adames)__KR912209.1__GP
  source 1..3942: mol_type = other RNA
atgatcttcaccatcctgaacgtgctgaccagagccatgctggtgatgagcatgtacagcctgaccacctgggacagcagcagcagaaacgacatctgcttcagcaacgacagccccctggagggcctggtgtactactgggagacccacagcaagaagcacgactacaagaagcagggcagccagaagtgcagagtgggcgacagcgacaagaagatgatcagcaacgtgaccatcatcagcctgatcagcgagatccagaagagcatcagcgagctgagcctgagctgcggcaacaacgacaacagcaccggccaggtgctgaccttcaacggcctggaggacaccatcagaggcgactacatcgtggactgcgtgaccggcctgtaccagagcgacatcggcgtgggcgtgggcctgggcagaatcaaccacgaccaccagcaggtgaagaacaaggccgtggtgatcgacgagaaggagaagatgatcagcctgctggagacccagcagagcgagaacgacatcaagacccaggtgctgatgagcgagatcgagcagctgaagaaccagctgagcaagagaagaaacgagagaggccaggagaagagagacgccgagaagctgatgagcgacctgatggccagaaacagcgacctgagaaaccacaacgtgatcctgaccgacgagatcagccagatcaagaacaacatcaccatccacagaaacagaaacatgatgagcaccaccgtggtgcccgccatcctgagcgtggccctgctgagcagcagcgtgggccccatcaccgccgccccccccgacagcaccatgatcaacccctggccccacgccaagaacagagtgggcaccggcatgtacaagtacgacgagaacgacgagagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacatctacagcggccccaagatccccttcaagggcgtgtgcaagatcggcctgatcaagtacaaggagtgcaagttcaagaccagcagctacgagaccatcagcttcatcaccctgaagggcaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacatcttctgcgagaagtacgactgcagcaccagctaccccgacgtgacctgcatccacacccccggcagcggccccctgtacatcaacctgatgggcagctggatcaagccccagtgcgtgggctacgagagagtgctggtggacagagaggtgaagcagcccctgctggtgcccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcatcccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgccttcagcgtgaccaccaacgtgctgtacgtgctgagactgatccccaagcagctgaagagccccgtgggctggctgaagctgttcgtgaactggctgctgaccgccctgagaatcaagaccagaagagtgatgggcagaatcaaccagagaatcggctgggtggaccaccacgacgtggagagacccagacacagagagcccatgagaagattcaagaccaccctgctgctgaccctgatcatggtgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagatggagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcatcttcatcaacaaggtgaagagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcaccagagactactgccaggtgctgcacttccagaagcccctggtggacgagagactgagctacagctgcggcagcgagcccaagctgatcgtgatcaagggcaccctggtgtacatgggcgtgtacgacttcagagacaagaccggcggcagcagcaccgtgatcaaccccagcgagggcacctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9430 - RNA, 3942 nt, synthetic construct
  misc_feature 1..3942: note = derived and/or modified CDS sequence (opt4) from PTV(Balliet)__KR912213.1__GP
  source 1..3942: mol_type = other RNA
atgatcttcaccatcctgaacgtgctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacggccaccagcagatgaagaacaaggccgtggtgatcgacgagaaggagagaatgatcagcctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatgaagaacaagaacaccatccagagaaacaagaacaccgtgagcaccaccgtggtgcccgccatcctgagcgtggccctgctgagcagcagcgtggcccccatcatcgccgccccccccgacagccccatgatcaacccctggccccacgccaagaacagagtgggcaccggcatgtacaagtacgacgagaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgtgggccaggacgagcaggaggtggagcacagagccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggagcccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatcctgtacgtgctgagactgatccccaagcagctgaagagccccgtgggctggctgaagctgttcatcaactggctgctgaccgccctgagaatcaagaccagaaacgtgatgagaagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacaacgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgaagaactgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcgtgctgttcatgatcctgatcagaatcgccgtgaacagcatcaacatcaagaagaagaactga

SEQ ID NO: 9431 - RNA, 3942 nt, synthetic construct
  misc_feature 1..3942: note = derived and/or modified CDS sequence (opt4) from PTV(PaAR2381)__KP272005.1__GP
  source 1..3942: mol_type = other RNA
atgatcttcaccatcctgaacatcctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagaagtgcagagtgggcgacagcgacaagaagatgatcagcaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacgaccaccaccaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcagaaagagaaacgagagaggccaggagaagagagacgccgagaaggtgatgagcgacctgatggccagaaacagcgacctgagaaagcacaacgacatcctgaccgccgagatcagccagatgaagtacaacaacaccatccagagaagcaagaacgtgatgagcaccaccgtggtgcccgccatcctgagcgtggccctgctgagcagcagcgtggcccccatcatggccgccccccccgacagccccatgatcaacccctggccccacgccaagaacagagtgggcaccggcatgtacaagtacgacgacaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacaactacagcggccccaagatccccttcaagggcgtgtgcagaatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgaggcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgaagctgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgaagagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcatgatcagaatcgccgtgaacagcatcaacatcaagaagaagaactga

SEQ ID NO: 9432 - RNA, 3942 nt, synthetic construct
  misc_feature 1..3942: note = derived and/or modified CDS sequence (opt4) from PTV(PAN483391)__KP272008.1__GP
  source 1..3942: mol_type = other RNA
atgatcttcaccatcctgaacatcctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacgaccaccagcaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatgaagtacgacaacaccatccagagaaacaagaacgtgatgagcaccaccgtggtgcccgccatcctgagcgtggccctgctgagcagcagcatcgcccccatcatggccgccagccccgacagccccatgatcaacccctggccccacgccaagaacagagtgggcaccggcatgtacaagtacgacgagaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagaaggtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcaagatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgagactgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgaaggccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgagaagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9433 - RNA, 3942 nt, synthetic construct
  misc_feature 1..3942: note = derived and/or modified CDS sequence (opt4) from PTV(GML902876)__KP272011.1__GP
  source 1..3942: mol_type = other RNA
atgatcttcaccatcctgaacgtgctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagaagtgcagagtgggcgacagcgacaagaagatgatcagcaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacgaccaccaccaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcagaaagagaaacgagagaggccaggagaagagagacgccgagaaggtgatgagcgacctgatggccagaaacagcgacctgagaaagcacaacgacatcctgaccgccgagatcagccagatggagaacaacaacaccatccagagaaacaagaacgtgatgagcaccaccgtggtgcccgccatcctgagcgtggccctgctgagcagcagcatcgcccccatcatggccgccagccccgacagccccatgatcaacccctggccccacgccaagaacagagtgggcaccggcatgtacaagtacgacgagaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcatccaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacatcttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgagactgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcagcaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtggccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgaagagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcatgatcagaatcgccgtgaacagcatcaacatcaagaagaagaactga

SEQ ID NO: 9434 - RNA, 3942 nt, synthetic construct
  misc_feature 1..3942: note = derived and/or modified CDS sequence (opt4) from PTV(PAN479603)__KP272014.1__GP
  source 1..3942: mol_type = other RNA
atgatcttcaccatcctgaacatcctgaccagagccatgctggtgatgagcatgtacagcctgaccacctgggacagcaccagcagaaacgacatgtgcttcagcaacgacagccccctggagggcctggtgtactactgggagacccacagcaagagacacgactacaagaagcaggagagccagaagtgcagagtgggcgacagcgacaagaagatgatcagcaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacgaccaccaccaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcagaaagagaaacgagagaggccaggagaagagagacgccgagaaggtgatgagcgacctgatggccagaaacagcgacctgagaaagcacaacgacatcctgaccgccgagatcagccagatgaagtacgacaacaccatccagagaaacaagaacgtgatgagcaccaccgtggtgcccgccatcctgagcgtggccctgctgagcagcagcgtggcccccatcatcgccgccccccccgacagccccatgatcaacccctggccccacgccaagaacagagtgggcaccggcatgtacaagtacgacgacaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgaagctgttcatcaactggctgctgaccaccctgagaatcaagaccagaaacgtgatgggcagaatcaaccagagaatcggctgggtggaccacttcgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacagagtgaagagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9435 - RNA, 3942 nt, synthetic construct
  misc_feature 1..3942: note = derived and/or modified CDS sequence (opt4) from PTV(PAN478718)__KP272017.1__GP
  source 1..3942: mol_type = other RNA
atgatcttcaccatcctgaacgtgctgaccagagccatgctggtgatgagcatgtacagcctgaccacctgggacagcagcagcagaaacgacatgtgcttcagcaacgacagccccctggagggcctggtgtactactgggagacccacagcaagaagcacgactacaagaagcaggagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacgaccaccagcaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatgaagtacaacaacaccatccagagaaacaagaacatcatgagcaccaccgtggtgcccgccatcctgagcgtggccctgctgagcagcagcgtggcccccatcatggccgccccccccgacagccccatgatcaacccctggccccacgccaagaacagagtgggcaccggcatgtacaagtacgacgacaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacagcagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgaagctgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcgtgaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgatcagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9436 - RNA, 3942 nt, synthetic construct
  misc_feature 1..3942: note = derived and/or modified CDS sequence (opt4) from PTV(Balliet)__KP272023.1__GP
  source 1..3942: mol_type = other RNA
atgatcttcaccatcctgaacgtgctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcagaagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacggccaccagcagatgaagaacaaggccgtggtgatcgacgagaaggagagaatgatcctgctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatgaagaacaagaacaccatccagagaaacaagaacaccgtgagcaccaccgtggtgcccgccatcctgagcgtggccctgctgagcagcagcgtggcccccatcatcgccgccccccccgacagccccatgatcaacccctggccccacgccaagaacagagtgggcaccggcatgtacaagtacgacgagaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacaaggccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggagcccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatcctgtacgtgctgagactgatccccaagcagctgaagagccccgtgggctggctgaagctgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacaacgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgaagaactgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcgtgctgttcatgatcctgatcagaatcgccgtgaacagcatcaacatcaagaagaagaactga

SEQ ID NO: 9437 - RNA, 3942 nt, synthetic construct
  misc_feature 1..3942: note = derived and/or modified CDS sequence (opt4) from PTV(Adames)__KP272029.1__GP
  source 1..3942: mol_type = other RNA
atgatcttcaccatcctgaacgtgctgaccagagccatgctggtgatgagcatgtacagcctgaccacctgggacagcagcagcagaaacgacatctgcttcagcaacgacagccccctggagggcctggtgtactactgggagacccacagcaagaagcacgactacaagaagcagggcagccagaagtgcagagtgggcgacagcgacaagaagatgatcagcaacgtgaccatcatcagcctgatcagcgagatccagaagagcatcagcgagctgagcctgagctgcggcaacaacgacaacagcaccggccaggtgctgaccttcaacggcctggaggacaccatcagaggcgactacatcgtggactgcgtgaccggcctgtaccagagcgacatcggcgtgggcgtgggcctgggcagaatcaaccacgaccaccagcaggtgaagaacaaggccgtggtgatcgacgagaaggagaagatgatcagcctgctggagacccagcagagcgagaacgacatcaagacccaggtgctgatgagcgagatcgagcagctgaagaaccagctgagcaagagaagaaacgagagaggccaggagaagagagacgccgagaagctgatgagcgacctgatggccagaaacagcgacctgagaaaccacaacgtgatcctgaccgacgagatcagccagatcaagaacaacatcaccatccacagaaacagaaacatgatgagcaccaccgtggtgcccgccatcctgagcgtggccctgctgagcagcagcgtgggccccatcaccgccgccccccccgacagcaccatgatcaacccctggccccacgccaagaacagagtgggcaccggcatgtacaagtacgacgagaacgacgagagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacatctacagcggccccaagatccccttcaagggcgtgtgcaagatcggcctgatcaagtacaaggagtgcaagttcaagaccagcagctacgagaccatcagcttcatcaccctgaagggcaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacatcttctgcgagaagtacgactgcagcaccagctaccccgacgtgacctgcatccacacccccggcagcggccccctgtacatcaacctgatgggcagctggatcaagccccagtgcgtgggctacgagagagtgctggtggacagagaggtgaagcagcccctgctggtgcccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcatcccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgccttcagcgtgaccaccaacgtgctgtacgtgctgagactgatccccaagcagctgaagagccccgtgggctggctgaagctgttcgtgaactggctgctgaccgccctgagaatcaagaccagaagagtgatgggcagaatcaaccagagaatcggctgggtggaccaccacgacgtggagagacccagacacagagagcccatgagaagattcaagaccaccctgctgctgaccctgatcatggtgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagatggagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcatcttcatcaacaaggtgaagagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcaccagagactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtgatcaaccccagcgagggcacctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9438 - RNA, 3942 nt, synthetic construct
  misc_feature 1..3942: note = derived and/or modified CDS sequence (opt4) from PTV(GML488831)__KP272032.1__GP
  source 1..3942: mol_type = other RNA
atgatcttcaccatcctgaacgtgctgaccagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagagcccaccacgaccaccagcaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatgaagtacaacaacaccatccagagaagcaagaacgtgatgagcaccaccgtggtgcccgccatcctgagcgtggccctgctgagcagcagcgtggcccccatcatggccgccccccccgacagccccatgatcaacccctggccccacgccaagaacagagtgggcaccggcatgtacaagtacgacgacaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgagcctgcaggacgccatctgccaggagaacagcgacaactacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgaagctgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgagaagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatcggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9439 - RNA, 3942 nt, synthetic construct
  misc_feature 1..3942: note = derived and/or modified CDS sequence (opt4) from PTV(GML488778)__KP272038.1__GP
  source 1..3942: mol_type = other RNA
atgatcttcaccatcctgaacgtgctgatcagagccatgctggtgatgagcatgtacagcctgaccacctgggacagcaccagcagaaacgacatgtgcttcagcaacgacagccccctggagggcctggtgtactactgggagacccacagcaagaagcacgactacaagaagcaggagagccagagatgcagagtgggcgacagcgacaagaagatgatcaccaacgtgaccatcatcagcctgatcagcgagatccagaagagcatcagcgagctgagcctgagctgcggcaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacgaccaccagcaggtgaagaacaaggccgtggtgatcgacgagaaggagagaatgatcagcctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacggcatcctgaccgccgagatcagccagatgaagtacaacaacaccgtgcagagaagcaagaacgtgatgagcaccaccgtggtgcccgccatcctgagcgtggccctgctgagcagcagcgtggcccccatcatggccgccccccccgacagccccatgatcaacccctggccccacgccaagaacagagtgggcaccggcatgtacaagtacgacgacaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgagcctgcaggacgccatctgccaggagaacagcgacaactacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgccggccaggacgagcaggaggtggagcacagagccctgaagagagtgagcgtgaacgactgcaagatcgtggacagcagcaagcagaagatctgcaccggcgaccacgtgttctgcgagaagttcgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatgctgtacgtgctgagactgatccccaagcagctgaagagccccgtgggctggctgaagctgttcatcaactggctgctgaccgccctgagaatcaagaccagaaacgtgatgggcagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagagccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcatcttcatcaacaaggtgagaagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtacatgggcgtgtacgacttcagaaacaagaccggcggcagcagcaccgtggtgaaccccagcgagggcgcctggagcatcagcaactggttcagcggcctgctggactggctgggcggccccatgaaggccatcatcaagatcctgggcttcatcgccatcggcgtggtgtgcttcatcctgttcatgatcctgatcagaatcgccgtgaacagcatcaacatcaagaagaagaactga

SEQ ID NO: 9440 - RNA, 3945 nt, synthetic construct
  misc_feature 1..3945: note = derived and/or modified CDS sequence (opt4) from PTV(Adames)__DQ363407.1__GP
  source 1..3945: mol_type = other RNA
atgatcttcaccatcctgaacgtgctgaccagagccatgctggtgatgagcatgtacagcctgaccacctgggacagcagcagcagaaacgacatctgcttcagcaacgacagccccctggagggcctggtgtactactgggagacccacagcaagaagcacgactacaagaagcagggcagccagaagtgcagagtgggcgacagcgacaagaagatgatcagcaacgtgaccatcatcagcctgatcagcgagatccagaagagcatcagcgagctgagcctgagctgcggcaacaacgacaacagcaccggccaggtgctgaccttcaacggcctggaggacaccatcagaggcgactacatcgtggactgcgtgaccggcctgtaccagagcgacatcggcgtgggcgtgggcctgggcagaatcaaccacgaccaccagcaggtgaagaacaaggccgtggtgatcgacgagaaggagaagatgatcagcctgctggagacccagcagagcgagaacgacatcaagacccaggtgctgatgagcgagatcgagcagctgaagaaccagctgagcaagagaagaaacgagagaggccaggagaagagagacgccgagaagctgatgagcgacctgatggccagaaacagcgacctgagaaaccacaacgtgatcctgaccgacgagatcagccagatcaagaacaacatcaccatccacagaaacagaaacatgatgagcaccaccgtggtgcccgccatcctgagcgtggccctgctgagcagcagcgtgggccccatcaccgccgccccccccgacagcaccatgatcaacccctggccccacgccaagaacagagtgggcaccggcatgtacaagtacgacgagaacgacgagagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacatctacagcggccccaagatccccttcaagggcgtgtgcaagatcggcctgatcaagtacaaggagtgcaagttcaagaccagcagctacgagaccatcagcttcatcaccctgaagggcaagggcaagatctacatcgagcacctgatgctgaagaacatcgaggtggtgaccaacgtgagcttcgtgtgctacgagcacgccggccaggacgacgagcaggaggtggagcacagagccctgaagagagtgagcgtgaacgactgcaagatcgtggacaacagcaagcagaagatctgcaccggcgaccacatcttctgcgagaagtacgactgcagcaccagctaccccgacgtgacctgcatccacacccccggcagcggccccctgtacatcaacctgatgggcagctggatcaagccccagtgcgtgggctacgagagagtgctggtggacagagaggtgaagcagcccctgctggtgcccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcgtgatcatcccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgccttcagcgtgaccaccaacgtgctgtacgtgctgagactgatccccaagcagctgaagagccccgtgggctggctgaagctgttcgtgaactggctgctgaccgccctgagaatcaagaccagaagagtgatgggcagaatcaaccagagaatcggctgggtggaccaccacgacgtggagagacccagacacagagagcccatgagaagattcaagaccaccctgctgctgaccctgatcatggtgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagatggagctggtgaccctgggcagcctgggcaccaagttcctgaactggggcaccctgagcctgagcctggacgccgagggcatcagcggcaccaacagcatcagcttcctggagagcagcaagggcggcttcgccctgtacgacgagggctacagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcatcttcatcaacaaggtgaagagctgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcaccagagactactgccaggtgctgcacttccagaagcccctggtggacgagagactgagctacagctgcggcagcgagcccaagctgatcgtgatcaagggcaccctggtgtacatgggcgtgtacgacttcagagacaagaccggcggcagcagcaccgtgatcaaccccagcgagggcacctggagcatcagcaactggttcagcggcctgctggactggctgggcggccccatgaaggccatcctgaagatcctgggcttcatcgccatcggcatcgtgtgcttcatcctgttcatgatcctgatcagaatcgccgtgaacagcatcaacatcaagaagaagaactga

SEQ ID NO: 9441 - RNA, 3942 nt, synthetic construct
  misc_feature 1..3942: note = derived and/or modified CDS sequence (opt4) from PTV__M11156.1__GP
  source 1..3942: mol_type = other RNA
atgatcttcaccatcctgaacgtgctgaccagagccatgctggtgatgagcatgtacagcctgaccacctgggacagcaccagcagaaacgacatgtgcttcagcaacgacagccccctggagggcctggtgtactactgggagacccacagcaagagacacgactacaagaagcaggagagccagagatgcagagtgggcgacagcgacaagaagatgatcaccaacgtgaccatcatcagcctgatcagcgagatccagaagagcatcagcgagctgagcctgagctgcgtgaacgacgacaacagcaccggccaggtgctgaccttcaacggcctggaggacaccatcagaggcgactacatcgtggactgcgtgaccggcctgtaccagagcgacatcggcgtgggcgtgggcctgggcagaacccaccacggccaccagcagatgaagaacaaggccgtggtgatcgacgagaaggagagaatgatcagcctgctggagacccagcagagcgagaacgacatcaagatgcaggtgctgatgagcgagatcgagcagctgaagaaccagctgagcaagaagagaaacgagagaggccaggagaagagagacgccgagaaggtgatgagcgacctgatggccagaaacagcgacctgagaaagcacaacgacatcctgaccgccgagatcagccagatgaagaacaagaacaccatccagagaaacaagaacaccgtgagcaccaccgtggtgcccgccatcctgagcgtggccctgctgagcagcagcgtggcccccatcatcgccgccccccccgacagccccatgatcaacccctggccccacgccaagaacagagtgggcaccggcatgtacaagtacgacgagaacgacgacagcggctgcagacccatcagatacggcgtgagctgcatcggcttcgacttcatgctgaagatggacaagtaccccttcttcaacgccttcatcggccacaagacccccctggagagcttcgccgacaagatcatcgagaaggaggaggagacctgcgagatcggcaccaacaaggagttcaagtgcttcgaggagagagcctacatcaagggcacctgccccaccaacatcaacgccgtgcactacatcgacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggagaacagcgacacctacagcggccccaagatccccttcaagggcgtgtgcaagatcggcctgatcaagtacaaggagtgcaagttcaagaccagcagctacgagaccgtgagcttcatcaccctgaaggagaagggcaagatctacatcgagcacctgatgctgaagaacatcgaggtggtgaccaacgtgagcttcgtgtgctacgagcacgtgggccaggacgagcaggaggtggagcacagagccctgaagagagtgagcgtgaacgactgcaagatcgtggacaacagcaagcagaagatctgcaccggcgaccacgtgttctgcgagaagtacgactgcagcaccagctaccccgacgtgacctgcatccacgcccccggcagcggccccctgtacatcaacctgatgggcagctggatcaagccccagtgcgtgggctacgagagagtgctggtggacagagaggtgaagcagcccctgctggcccccgagcagaactgcgacacctgcgtgagcgagtgcctggacgagggcgtgcacatcaagagcaccggcttcgagatcaccagcgccgtggcctgcagccacggcagctgcatcagcgcccaccaggagcccagcaccagcgtgatcgtgccctaccccggcctgctggccagcgtgggcggcagaatcggcatccacctgagccacaccagcgacagcgccagcgtgcacatggtggtggtgtgcccccccagagacagctgcgccgcccacaactgcctgctgtgctaccacggcatcctgaactaccagtgccacagcaccctgagcgccatcctgaccagcttcctgctgatcctgttcatctacaccgtgttcagcgtgaccaccaacatcctgtacgtgctgagactgatccccaagcagctgaagagccccgtgggctggctgaagctgttcatcaactggctgctgaccgccctgagaatcaagaccagaaacgtgatgagaagaatcaaccagagaatcggctgggtggaccaccacgacgtggagagacccagacacagagagcccatgagaagattcaagaccaccctgctgctgaccctgatcatgatgaccggcggcaacgcctgcagcaacaccgtggtggccaacagcaagcagaccagatgcgtgcaggagggcagcaacaccaagtgcagcatcaccgccaccatcaccctgagagccggcgtgatcggcgccgagagctgcttcatcatcaagggccccatggagaaccagcagaagaccatcagcatcaagaccatcagcagcgagaccgtgtgcagagagggcagcagcttctggaccagcctgtacatccccagctgcctgagcagcagaagatgccacctggtgggcgactgcgtgggcaacaagtgccagagctggagagacgaccagctgagcagagagttcagcggcgtgaaggacaaccacatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagccccggcaccaagttcctgaactggggcaccctgagcctgagcctggacgccgagggcatcagcggcaccaacagcatcagcttcctggagagcagcaagggcggcttcgccctgtacgacgagggctacaacgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaacggcgccatcaaggccctgctgagcatcaacctggacgaccacgagatcgtgttcatcaacaaggtgaagaactgcgacgccaccttcctgaacgtgagcggctgctacagctgcgactacggcgcccacgtgtgcgtgaaggtgaagagcagcgagagcgccgacttcttcgccgagagcgaggacaagaccaccgtgctgagcttccccatccagagcggcacccacgactactgccaggtgctgcacttccagaagcccctggtggacgagagactgagctacagctgcggcagcgagcccaagctgatcgtgatcaagggcaccctggtgtgcatgggcgtgtacgacttcagaaacaagaccggcggcagcagcaccgtggtgaaccccagcgagggcgcctggagcatcagcaactggttcagcggcctgctggactggctgggcggccccatgaaggccatcctgaagatcctgggcttcatcgccatcggcatcgtgtgcttcgtgctgttcatgatcctgatcagaatcgccgtgaacagcatcaacatcaagaagaagaactga

SEQ ID NO: 9442 - RNA, 3852 nt, synthetic construct
  misc_feature 1..3852: note = derived and/or modified CDS sequence (opt4) from Phlebovirus(CoAr170255)__HM566149.1__GP
  source 1..3852: mol_type = other RNA
atgtacaagctgatcaccaacatcctgaagctgagcgtggtgagcgccatgtacagcatcatgttctgggaccccaccggcatcagcaagctgtgcctgagcaacaacagccccctggagggcctggtgtactactgggagaacaccatgagagagggcgagttcaagagagagaagagaaagaagtgcagactgggcatcagcgagcccgcccccgtgagcaaccagaccatcgtgagcctgatcgaggaggtgcagaagagccccgccgagatgatcctgatctgcgaggccaacggcaacagcaccggcagcagcctgagcttcgacggcctgagcgacaacgagatcaagcccagcatcgtggactgcaccaccggcgacagaaccagcgacctgagagtgctggtgggcaagggcatcttcgagaagaagatgagcatgagcaacgagatcgacagagtggtgagcctggaggaccacctgcagagagagaaggagctggtgcagaccttccaggacctgcaccacaacgagagcgagaagaacaagctgctggagcacgagctggagaacgtgagacagcagctgaagagagagagagagagcaacaagatcaagatgtggaccaccaagagacccgagatcaccaccatcggcctgaccaccaccatcgccaccatcctgctggccagccagagcgtggccagcagcgtgcccatgcccggccagctgaacacctggccccacgccaagaacagagtgggcggcggcgtgttcaaggccaacgacgacgacgaggacagctgcaagctgatcgactacggcatcgcctgccacggcttcgactacctgctgagaaccgacatctaccccttcttcaacgcccacgtgagccacagaagcctgctggaggccagcaacgagggcatcatcctgaaggacgaggccagctgcgagatcgagaccaacaaggacttcaagtgctacgaggagagagccttcctgaagtggagctgcccccacctggtgaacagcgcccacttcatcgacagcaagggcaagctgagaatcatcaagtgcaaggccgagtacgagatcaccgaggactgcacctactgcagaagaatcaagaagaaggccgcccagcagaagcaggtgtacaagagcagcatcgccctgcaggacgccgtgtgccaggagaacagcgactactacgacggccccagaatcaccttcaccggcgtgtgcaagatcggcaccatggagtacaagaagtgcaagcacaagagcagcagcttcgagaacatcggcttcatcaccatcagagacaagggcaagtactacatcgagaacatgagaaccaagaacatcgagatggtgagcaacgtgagcttcatctgctacaaccacaacggccaggacaccgagaaggacgtgagactgctgaagagagtgaagcccggcgactgcaaggtggtggacgacagcaagaccaagcactgcaccggcgaccacgtgttctgcgagaagtacgactgcaccaagagctaccccgaggccacctgcatgcacgcccccggcagcggccccatcctggtgctggtgatgggcgtgtggttcaagccccagtgcgtgggctacgagagagtgctggtggagagagaggtgaaggcccccgtgctgatccaggagaaggactgcgacacctgcgtgttcgagtgcctggaggacaagatcctgatcaagagcaccggcttcaagatgatcagcgccgtggcctgcagccacggcagctgcgtgagcagccaccagagccccagcaccttcctgtacatcgactaccccggcctgaccgccagcgtgggcggcgagatcggcctgcacctgagccacaccgacgacagcgtgagcgtgcacaagaagatccactgccccgccagagacccctgcgaggcccacagctgcatcgtgtgctaccacggcctggtgaactaccagtgccacaccgtgctgagctacagcgtggtgagcttcctgctggtgtgcatgatgtacctggccttcttcatcaccagcagactgctgttcttcctgagaatcatgcccagaagactgagaaaccccatcagctggctgaccctgctgatcagatgggtgctgcagaccctgctggccatcctgagactgagcttcaagaagctgagcgagaccatcggctggaacagccccaacaacagacagcagatggacgtggaggccaacagaagacccctgagaagatacagaaccaccttcatcctgaccctgctgttcgtgggcctgaccagcgcctgcagcaacaccgccgtgagcaacagcaagcagaccaagtgcctgcagagcggcggcagcgtgaagtgcagcatcaccgccaccatcaccctgaaggccggcaccatcggcgccgagagctgcttcatcatcaagggccccagcgagaaccagcagaaggtgatcagagtgaagaccgtgagcagcgagaccgtgtgcagagagggcagcagcttctggaccggccagttcacccccagctgcgtgagcagcagaagatgccacctggtgggcgactgcgtgggcaacagatgccaggcctggagagacgaggtggtgagcagagagttcggcaacatgaaggacaacaacgtgatgagcgagaacaagtgcttcgagcagtgcggcgccgccggctgcggctgcttcaacatcaaccccagctgcctgtacgtgcacagcaccttcaagagcgtgagaagagaggccatcagagtgttcaagtgcaacgactgggtgcacagactgaccttcgaggtgagcggccccagcggcgagaaggacagaatcgtgctgaacagcctgagcaccaagttcctgcagtggggcaccatcagcctgagcctggacgccgagggcatcagcggcaccaacagctacagcttcctggagagcaacaagggcggcttcgccatccacgacgaggagttcagcgagatccccagagagggctacctgggcgagatcagatgcagcagcgagagcgccgtgatcgccgcccacaagagctgcatcagagcccccaacctgatcaagtacaagcccatgaccgaccagatcgactgcaccgccagcctggtggaccccttcgccatcttcctgaagggcagcctgccccagagcagaagcggctacaccttcaccagcagcaccgacaagaagaccgtgcaggccttcaacagcggcagcatcaaggccctgatcagcatcaacatggacgaccacgagatcgagttcctgaacgacgccgccgactgcgacgccaccttcctgaacgtgagcggctgctacagctgcaactacggcgcccaggtgtgcatcaaggtgagaagcagcaagagcagcatcttcagcagcaacaacaacgacaacagcatcgtgatcaacttcgacgccgaccagggcaccagagactactgcagaatcatccacttcaacggccccctggtggacgagaccctgcactacagctgcggcggcgagagcaagctgctgcagatgaagggcagcctgatcaccgtgggcccctacgacttcagaaacaccaccggcggcaagagcaccatcgtgaacccccacgaggagagctggaacctgttcagctggttcagcggcctgctggactggctgggcggccccctgagagccatcctgaagatcgtgctgatcatcatcatcggcatcatcctgttcatcgtggtggccttcctgatcagactggtgatcttcaacgtgctgctgaagagcaagaagaactga

SEQ ID NO: 9443 - RNA, 3873 nt, synthetic construct
  misc_feature 1..3873: note = derived and/or modified CDS sequence (opt4) from Phlebovirus(CoAr171616)__HM566154.1__GP
  source 1..3873: mol_type = other RNA
atgttccagatcatctacctgctgaccaagctgtacctggtgagcagcatgtacagcatcatgttctgggagaacgagaacatcagcaagctgtgcctgagcaacaacagccccctggagggcctggtgtactactgggagaacgtgatgaaggagggcgacttcaaggaggagaagagaaagaagtgcagaatcggccccagcgacctgaagagagtgaccaaccagaccctgaccaccctgatcgaggaggtgcagaagagccccagcgagatccagctgctgtgcgaggaggacggcaacaagaccggcatcagcatgttcttcgacggcctgagcgacgacatcagcacccccagcatcgtggactgcaacggcaacatcagaatcagcgacctgagagtgcaggtgggcagaggccacttcgagaaggagaacgagatcagaaagatcgaggagatcgtgaccctggaggacgacctgagaagagagagagacctgaacaagctgctgcaggacctgaacaagaaggacgccgaggagagaagaatcatcgagcacgagctgaccaacatgagagagcagctgcagagagagagagagagaagcaagcagcagatcaaggagcacgagaagatcgaggtgaacaaccacaaggagcccgccacccacctgaacgtgagcaagctgctgaccatcggcctgctggcccagcaggtgggccaggtgatcgccaccgagcccggccagctgaacacctggatccacgccaagaacagaatcggcaagggcctgtacaagaccgaggacaccgacgaggacggctgcagaggcctggactacggcgtgagctgcctgggcttcgactacctgctgagaaccgacatctaccccttcttcaacagcttcgtgagccacctgagcatgctggaggccagcaccgaggacctgatcgagaaggagggcaccagctgcgagatcgagaccaacaaggagttcaagtgctacgaggagagagccttcatcaagggcagctgcccccacctggtgaacagcgcccacttcctggacaacaagggcaagctgagaatcgtgaagtgcaagaccgacttcgagatgaccgaggactgcaccttctgcagaaagatcaagaagaagaacagccagcacaagcaggtgttcaagaccagcatcgccctgcaggacgccgtgtgccagaacaacagcgacctgtacaacggccccagaatcgtgtacagcaacgtgtgcaagatcggcatggtgagctacaagcagtgcaagagcaagaccagcagctacgagagcgtgggcttcgtgatcctgaagggcaagggcaagttctacatcgagaacatgaagatcaagaacatcgaggtgatcgccaacgtgagcttcatctgccaccagtaccagggccaggacggcaccgagaaggagcagagaagcctgaagagaatcagcgtgggcgagtgcaagagcgtgaacccccagaagaccaagcactgcaccggcgaccacgtgttctgcgagaagtacgactgcaccaagagctaccccgaggtgacctgcctgatggcccccggcagcggccccatcctggtgcagatcatgggcagctggatcaagccccagtgcgtgggctacgagaaggtgctggtggagagagaggtgaagagccccaccctgaccgaggagagagactgcgacacctgcgtgtacgagtgcctggaggacaagatcctgatcaagagcaccggcttcaagatgatcagcgccgtggcctgcagccacggcatgtgcgtgagcagccaccaggagcccagcaccttcctgtacatcaactaccccggcatgagcgccagcatcggcggcgagatcggcctgcacctgagccacaccgacgacagcctgagcctgcacaaggtgatcagctgccccagcagaaacccctgcgacgtgcacagctgcatcatctgctaccacggcatcatcaactaccagtgccacaccgccctgagctacaccatcgtggccttcagcttcatcagcttcctgtacctgaccttcaaggtgatcagccagctgctgtacaccttcaaggtggtgcccaagaagctgaagggccccttctactggatgggctacctgatcaagtggatcgtgaagaccatcctgggcgtggtgagaaacaccttcttcaccatgagcaacagaatcggctgggagagaagagacgagatccacgaggacatcgaggccaaccccagaagacacctgcagagattcaagaccaccttcgtgctgaccatgctgatgatcaacggcggcctgtgctgcagcaacaccctggtgagcaacagcaagcagaccagatgcgtgcagagcggcaacgaggtgaagtgcagcgtgagcgccaccgtggtgctgaaggccggcgtgatcggcgccgagagctgcttcatcatcaagggccccagcgagaaccagcacaagatgatcagcgtgagaaccctgagcagcgagaccgtgtgcagagagggcgccagcttctggaccggccacttcagccccagctgcgtgagcagcagaagatgccacctggtgggcgagtgccacggcaacagatgccagagctggagagacgaccagatcagcagagagttcggcggcgtgaaggacaacaacagaatgagcgagaacaagtgcttcgagcagtgcggcagcatcggctgcggctgcttcaacatgaaccccagctgcctgtacgtgcacaccaccctgaagagcgccagaaacgaggccgtgagagtgttcaagtgcaacgactggatccacagactgaacttcgaggtgatcggccccagcggcgagaaggacgtggtgaccctgaacagcatgagcaccaagttcctgcagtggggcaccatcagcctgagcctggacgccgagggcatcaccggcaccaacagctacagcttcctggagagcagcaagggcggcttcgccatccacgacgaggagttcagcgacatccccagagagggctacctgggcgagatcagatgcagcagcgagagcgccgtgatcagcgcccacagcagctgcatcagagcccccgacctgatcaagtacaagcccatgaccgaccagatcgagtgcaccagcaccctgatcgaccccttcgccatcttcatgaagggcagcctgccccagaccagaagcggctacaccttcaccagcagcaaggacaagaagaccatccaggccttcaacaccaacagcatcaaggccctgatcagcctgaacctggacgaccacgagatcgtgttcgtgagcgaccagaccaactgcgagtgcaccttcctgaacctgaccggctgctacagctgcgactacggcgcccacgtgtgcttcagaatcaagagcgacaagaagggcgtgttcgtgagcaacaccgaggccaaggacatcagcttcggcttcgaggtgctgaccggcacccacgactactgccagatccagcacttcaacagccccagcgtgtacaagaccctgagctacagctgcggcggcgagagcaagctgctggtgatcaagggcagcctgatcaccatcggcccccacgactacagaaacaagaccggcggcgccagcaccgtggtgaaccccagcgaggagggctggagcgtgaccaactggatcggcggcttcatcagctggctgggcggccccctgaaggccctgctgaagatcgccgtgaccatcctggccggcgtggtgatcttcctgatcatctacttcttcctgagactgatcgccaccaacatcctgatgaagaccaagaagaactga

SEQ ID NO: 9444 - RNA, 3852 nt, synthetic construct
  misc_feature 1..3852: note = derived and/or modified CDS sequence (opt4) from Buenaventura virus(CoAr3319)__KP272002.1__GP
  source 1..3852: mol_type = other RNA
atgtacaagctgatcaccaacatcctgaagctgagcatggtgagcgccatgtacagcatcatgttctgggaccccaccggcatcagcaagctgtgcctgagcaacaacagccccctggagggcctggtgtactactgggagaacaccatgagagagggcgagttcaagagagagaagagaaagaagtgcagactgggcatcagcgagcccgcccccgtgagcaaccagaccatcgtgagcctgatcgaggaggtgcagaagagccccgccgagatgatcctgatctgcgagaccagcggcaacgccaccggcagcagcctgagcttcgacggcctgagcgacaacgaggtgaagcccagcatcgtggactgcgccaccggcgagagaaccagcgacctgagagtgctggtgggcaagggcaccttcgagaagaagatgagcatgagcaacgagatcgacagagtggtgagcctggaggaccacctgcagagagagagagagctggtgcagaccttccaggacctgcaccacaacgagagcgagaagaacaagctgctggagcacgagctggagaacgtgagacagcagctgagaagagagagagagagcaacaaggtgaaggtgtggaccaccaagaagcccgaggtgaccaccatcggcctgaccaccaccatcgccaccatcctgctggccagccagagcatcgccagcagcgtgcccatgcccggccagctgaacacctggccccacgccaagaacagagtgggcggcggcgtgttcaaggccaacgacgacgacgaggacagctgcaagctgatcgactacggcatcgcctgccacggcttcgactacctgctgagaaccgacatctaccccttcttcaacgcccacgtgagccacagaagcatgctggaggccagcaacgagggcatcatcctgaaggacgaggccagctgcgagatcgagaccaacaaggacctgaagtgctacgaggagagagccttcctgaagtggagctgcccccacctggtgaacagcgcccacttcatcgacagcaagggcaagctgagaatcatcaagtgcaaggccgagtacgagatcaccgaggactgcacctactgcagaagaatcaagaagaaggccgcccagcagaagcaggtgtacaagagcagcatcgccctgcaggacgccgtgtgccaggagaacagcgactactacgacggccccagaatcaccttcaccggcgtgtgcaagatcggcagcatggagtacaagaagtgcaagcacaagagcagcagcttcgagaacgtgggcttcatcaccatcagagacaagggcaagtactacatcgagaacatgagaatcaagaacatcgagatggtgagcaacgtgagcttcatctgctacaaccacaacggccaggacaccgagaaggacatcagactgctgaagagagtgaagcccagcgactgcaaggtggtggacgacagcaagagcaagcactgcaccggcgaccacatcttctgcgacaagtacgactgcaccaagagctaccccgaggccagctgcatgcacgcccccggcagcggccccatcctggtgctggtgatgggcgtgtggttcaagccccagtgcgtgggctacgagagagtgctggtggagagagaggtgaaggtgcccgtgctgacccaggagaaggactgcgacacctgcgtgttcgagtgccaggaggacaagatcctgatcaagagcaccggcttcaagatgatcagcgccgtggcctgcagccacggcagctgcgtgagcagccaccagagccccagcaccttcctgtacatcgactaccccggcctgaccgccagcgtgggcggcgagatcggcctgcacctgagccacaccgacgacagcatcagcgtgcacaagaagatccactgccccgccagagacccctgcgaggcccacaactgcgtgatctgctaccacggcctgatcaactaccagtgccacaccttcctgagctacagcgtggtgagcttcctgttcatcagcgtgctgtacctgaccttcttcatcgtgagcagactgctgctgttcctgaagatcatgcccaagagactgaagaaccccatcagctggctgaccctgctgatcagatgggtgctgcagaccctgatcaccatcctgagactgagcttcaagaagctgagcgagaccatcggctggaccaccaacgacaacagacagcacgtggacgtggaggccaacagaagacccctgagaagatacagaaccaccttcatcctgaccctgctgttcatcggcctggccagcggctgcagcaacaccgccgtgagcaacagcaagcagaccaagtgcctgcagagcggcggcagcgtgaagtgcagcatcaccgccaccatcaccctgaaggccggcatcatcggcgccgagagctgcttcatcatcaagggccccagcgagaaccagcagagagtgatcagagtgaagaccatcagcagcgagaccgtgtgcagagagggcagcagcttctggaccggcctgttcacccccagctgcgtgagcagcagaagatgccacctggtgggcgactgcgtgggcaacagatgccagagctggagagacgaggtggtgagcagagagttcggcaacatgaaggacaacaacgccatgagcgagaacaagtgcttcgagcagtgcggcgccgccggctgcggctgcttcaacatcaaccccagctgcctgtacgtgcacagcgtgttcaagagcgtgagaagagaggccatcagagtgttcaagtgcaacgactgggtgcacagactgaccttcgaggtgagcggccccagcggcgagaaggacagaatcgtgctgaacagcctgagcaccaagttcctgcagtggggcaccatcagcctgagcctggacgccgagggcatcagcggcaccaacagctacagcttcctggagagcaacaagggcggcttcgccatccacgacgaggagttcagcgagatccccagagagggctacctgggcgagatcagatgcagcagcgagagcgccgtgatcgccgcccacaagagctgcatcagagcccccaacctgatcaagtacaagcccatgaccgaccagatcgactgcaccgccagcctggtggaccccttcgccatcttcctgaagggcagcctgccccagagcagaagcggctacaccttcaccagcagcaccgacaagaagaccgtgcaggccttcaacagcggcgccatcaaggccctgatcagcatcaacctggacgaccacgagatcgagttcctgagcgacaccgccgactgcgacgccaccttcctgaacatcagcggctgctacagctgcaactacggcgcccaggtgtgcatcaaggtgagaagcagcaagagcagcatcttcagcagcaacaacaacgacaacagcatcgtgatcaacttcgacgccgagcagggcaccagagactactgcagaatcatccacttcaacggccccctggtggacgagaccctgcactacagctgcggcggcgagagcaagctgctgcagatgaagggcagcctgatcaccgtgggcccctacgacttcagaaacaccaccggcggcaagagcaccgtggtgaacccccacgaggagagctggaacctgttcagctggttcagcggcctgctggactggctgggcggccccctgagagccatcctgaagatcgtgctgatcgtgatcatcggcatcatcctgttcatcgtggtggtgttcctgatgagactggccatcctgaacgtgctgctgaagagcaagaagaactga

SEQ ID NO: 9445 - RNA, 3942 nt, synthetic construct
  misc_feature 1..3942: note = derived and/or modified CDS sequence (opt4) from Cocle virus(GML244915)__KP272034.1__GP
  source 1..3942: mol_type = other RNA
atgatgttcacccacctggacgtgctgaccagagccatgctggtgatgagcatgtacagcctgaccacctgggacagcatcagaagaaacgacatctgcttcagcaacgacagccccctggagggcctggtgtactactgggagacccagagcaagatgcacgagtacaagaaggaggacagccagaagtgcagagtgggcgacagcgagaagaagatgatcagcaacgtgaccatcatcagcctgatcagcgagatccagaagagcatcagcgagctgagcctgagctgcggcaacgacgacaacagcaccggccaggtgctgatgttcaacggcctggaggacaccatcagaggcgactacatcgtggactgcctgaccggcctgtaccagagcgacatcggcgtgggcgtgggcagcggcaagaccaagcacgaccacaccaagctgagaaacaaggccgtgatcatcgacgagaaggagaagatgatcagcctgctggaggcccagcagagcgagaacgacatcaagacccaggtgctgatgagcgagatcgagcagctgaagacccagctgctgaacagaagaagcgagagaggccacgagaagagaaagaacgaggagatcgtgagcgacctgatggccagaaacagcgacctgagaaagcacaacgacatcctgaaggacgagatggaccagatcaaggagaacctgaccatcttcaagagcagaaacgccatcagcaccaccagcgtgcccgccatcatgagcatcgccctgctgagcagcagcgtgatgcccatcatcgccgccgtgagcgacagccccatgatcaacccctggccccacgccaagaacagagtgggcagcggcatgtacaagtacgacgacaacgacgagagcggctgcagacccatcagatacggcgtgagctgcatcggcttcgaccacatgctgaagatggacaagtaccccttcttcaacgccttcatcggccacaagaccctgctggagagcttcgtggacaagatcatcgagaaggaggacgagacctgcgagatcggcaccaacaaggagttcaagtgcttcgaggagagagcctacatcaagggcacctgcccccacaacatcaacgccgtgcactacctggacaacaagggcaagctgagatacgtgaagtgcaaggagaacctggagatgaccgaggactgcgccttctgcagaaagatcaagaagaaggccggccagagcgtgcaggtgcagaagaccagcgtgcccctgcaggacgccatctgccaggacaacagcgacatctacaccggccccagaatcccctacaagggcatgtgcaagatcggcctggtgaagtacaaggagtgcaagagcaagaccagcagctacgagaccgtgagcttcatcaccctgaagggcaagggcaagatctacatcgagcacctgatgctgaagaacatcgaggtggtgaccaacgtgagcttcgtgtgctacgagcacgccggccaggtggagcaggaggtggagcacagagccctgaagagagtgagcgtgaacgactgcaagatcgtggacagcagcaagcagaagatctgcaccggcgaccacgtgttctgcgagaagtacgactgcagcaccagctaccccgacgtgacctgcatccaggcccccggcagcggccccctgtacgtgaacctgatgggcagctggatcaagccccagtgcgtgggctacgagagagtgctggtggagagagaggtgaagcagcccctgctgacccccgagcagaactgcgacacctgcgtgagcgagtgcctggacgagggcgtgcacatcaagagcaccggcttcgagatcaccagcgccgtggcctgcagccacggcagctgcatcagcgcccaccaggaggccagcaccagcatcatcgtgccctaccccggcctgctggccagcgtgggcggcaagatcggcctgcacctgagccacaccagcgacagcgccagcgtgcacatgatcgtggtgtgcccccccagagacagctgcgccgcccacaactgcctgctgtgctaccacggcatgctgaactaccagtgccacagcaccctgagcgccatcctgaccagcttcctgctgatcctgttcatctacaccaccttcagcttcatcaccaacatcctgtacctgctgagactgctgcccaagcagctgaagagccccatcggctggctgaagctgttcatcaactggctgttcaccatcctgagaatcagaaccaagtacctgatgggcagactgaaccagagaatcggctgggtggagaaccacgacgtggagagacccagacccagagagcccatgagaagattcaagaccaccctgatgctgaccatgctgatgatcaccggcggctacgcctgcagcaacaccgtggtggccaacagcaagcagaccagatgcgtgcaggagggcagcaacaccaagtgcagcgtgaccgccaccgtgaccctgaaggccggcgtgatcggcgccgagagctgcttcgtgatcaagggccccatggagaaccagcagaagaccatcagcatcaagaccgtgagcagcgagaccgtgtgcagagagggcagcagcttctggaccagcctgtacatccccagctgcctgagcagcagaagatgccacctggtgggcgactgcgtgggcaacagatgccagagctggagagaggaccagctgagcagagagttcagcggcgtgaaggacaaccagatcatgaacgagaacaagtgcttcgagcagtgcggcgccatcggctgcggctgcttcaacatcaaccccagctgcctgtacgtgcacgcctacctgaagagcgccagaaacgaggccgtgagagtgttcagctgcagcgactgggtgcacagagtgagcttcgaggtgaagggccccgacggcgagaccgagctggtgaccctgggcagcctgggcaccaagttcctgaactggggcaccctgagcctgagcctggacgccgagggcatcaccggcaccaacagcctgagcttcctggagagcagcaagggcggcttcgccctgtacgacgagggcttcagcgagatccccagagagggcttcctgggcgagatcagatgcagcagcgagagcgccgccatcagcgcccacaagagctgcatcagagcccccggcctgatcaagtacaagcccatgaccgaccagatcgagtgcaccgccagcctggtggaccccttcgccatcttcctgaagggcagcctgccccagaccagaaacggccagaccttcaccagcaccaaggacaagaagaccgtgcaggccttcaccaccggcgccatcagagccctgctgagcatcaacctggacgaccacgagatcaccttcatcagcaagatcaagaactgcgaggccaccttcctgaacgtgagcggctgctacagctgcgactacggcgcccacgtgtgcatcaagatcaagagcagcgagagcgccgacttctacgccgagagcgaggacaagaccaccgtgctgagcctgcccgtgagcagcggcacccaggactactgccaggtgctgcacttccagaagcccctggtggacgagagactgagctacagctgcggcagcgagcccaagctgatggtgatcaagggcaccctggtgtacatgggcgtgtacgacttcagaaacaagaccggcggcagcagcaccgtggtgaaccccagcgacgccagctggagcatcgccaactggttcagcggcctgctggactggctgggcggccccctgaaggccatcctgaagatcctgggcttcatcgccatgggcgtggtgtgcttcatcctgttcatgatcctgatcaagatcgccgtgagaagcgtgaacatgaagaagaagaactga

SEQ ID NO: 9446 - RNA, 3873 nt, synthetic construct
  misc_feature 1..3873: note = derived and/or modified CDS sequence (opt4) from Campana virus(VP-334K)__KP272041.1__GP
  source 1..3873: mol_type = other RNA
atgctgcacttcatcaccatcaccaccaagttcctggccgtggccagcatgtacaacctgctgtactgggaccccaacggcctgagcagactgtgcctgagcaacaacagccccctggagggcctggtgtactactgggagaacctgatgaaggagagcgacttcaagaaggacaagaagaagcactgcagaatcggcaccagcgtggccgcccccgtgaccaacgagaccctgaccaccctgatcgaggaggtgcagaagagccccagcgagatcatcctgcagtgcgagagcagaaacaacgacaccggcaacagcatctacttcgacggcctggccgacgacatcgagagccccagcatcgtgaactgcgagagcggcaagagagagagcgacctgagagtgctggtgggccagggcctgaagaaggagatcatcctgaacgagatcgccgccatcgacagacaggccagcctggaggagcacctgagaggcgagaaggccctgaccagcctgctgcaggagatcagcaagcaggacgaggccgagagaaagagactggagcacgaggtgagcagcctgagacagcagctgatgaacgagagagaggagaacaagaagagaaagaacatccccgccttcggcgtgagcagcaccaccagcagcagcctgatgaacatcagcagagtggtgaccatcggcctgctgagccagcaggccatcgccaaccccagcctgcccggccaggtgaacacctggccccacgccaagaacagaatcggccagggcctgtacagaatcgacaccagcgacgaggacggctgcagaggcctgaactacggcgtgatctgcctgggcttcgaccacctgctgagaatggacctgtaccccttcttcaacgcctacgtgagccacctgagcctgctggaggcctacaccgagaacatcatccagaaggacgagaccgagtgcgagatcgagggcggcaaggagttcaagtgctacgaggagagagcctacatcaagggcgtgtgcccccacagaatcaagagcgcccactacctggaccagaagggcaagctgagaatcatcaagtgcaaggagaacctggagctgaccgaggactgcacctactgcagaaagatcaagaaggacagaggccacaccaagcaggtgtacaagaccagcgtgcccctgcaggacgccatctgccaggacaacagcgacgactacagcggccccaagatcagcttcaagggcgtgtgcaagatcggcatgatcgagtacaaggagtgcaagtacaagagcagcagcttcgagaccgtgggcttcatcaccatcaaggagaagggcaagttctacatcgaggacatgaagctgaagaacctggaggtgaccaacaacgtggccttcatctgccaccagtacaccggccaggacggcaccaccgacgaggagaacagacacctgaagagaatgagcgtgaaggactgcaagaacgtgaacagcagcaagagcaagtactgcaccggcgaccacatcttctgccaggtgtacgactgcaccaagagctaccccgaggccacctgcttcgtggcccccggcagcggccccgtgctggtgcaggtgatgggcagctggatcaagccccagtgcgtgggctacgagaaggtgctggtggagagagaggtgaagatgcccatcctgaccgaggagagagactgcgacacctgcgtgtacgagtgcaaggaggaccacatcctgatcaagagcaccggcttcaacatgatcagcgccgtggcctgcagccacggcagctgcgtgagcgcccaccaggaccccagcaccttcctgaacatcgagtaccccggcatgagcgccagcgtgggcggcgagatcggcatccacatcagccacaccgacgacagcctgagcctgcacaagaagatctactgccccgccagagacagctgcgaggcccacaactgcatcatgtgctaccacggcctgatcaactaccagtgccacaccgccctgagctacgccgtggtgagcttcatgttcgtgagcatcgcctacgtgatcttcaacgtgctgagactggtgctggtggccctgcacgtggtgcccagaaagctgaagagccccatcgactggctgatcctgctgatcaagtgggtgttcctgctgctggccaaggtgatcagagccttcctgacccacctgaacaccaccatcggctggagagagagacagaacaacttcgccgccgacctggaggcccagagaagacccctgcagagattcaagaccaccgtgctgctgatgatgatgctgatcagcgtggtgagcagctgcagcaacagcgtggtgagcaacagcaagcagaccagatgcatccagagcggcagcaacaccaagtgcagcgtgagcgccaccatcaccctgaaggccggcgtgatcggcgccgagagctgcttcgtgatcaagggccccagcgagaaccagcacaagaccatcgtgatcagaaccgtgagcagcgagaccatctgcagagagggcagcagcttctggaccggccacttcacccccagctgcctgagcagcagaagatgccacctggtgggcgactgcgtgggcagcagatgccagggctggagagaggacgtgatcagcagagagttcggcggcgtgaaggacaacaaccagatgagcgagaacaagtgcttcgagcagtgcggcgccgccggctgcggctgcttcaacatcaaccccagctgcctgtacgtgcacaccatcctgagaagcgccagaaacgaggccgtgagagtgttcaagtgcaacgactgggtgcacaagctgaccttccacatcaagggccccaacggcgaggaggaggacgtggtgctgaacagcctgagcaccaagttcctgagctggggcaccatcagcctgagcctggacagcgagggcatcaccggcaccaacagctacagcttcctggagagcagcaagggcggcttcgccatccacgacgaggagttcagcgagatccccagagagggcttcctgggcgagatcagatgcagcagcgagagcgccgtggtgagcgcccacaagagctgcatcagagcccccggcctgatcaagtacaagcccatgaccgaccaggtggagtgcagcgccagcctggtggaccccttcgccatcttcatcaagggcagcctgccccagaccagaagcggctacaccttcaccagcagcagagacaagagaaccatccaggccttcaacaacggcgccatcaaggccctgctgaccctgaacctggacgaccacgaggtgatcttcagcgagagcgtgatcacctgcgagtgcaccttcctgaacatcagcggctgctacagctgcaacttcggcgcccaggtgtgcttcaagatcaagagcagcggcatcggcgacttcgtgagcagcagcgagaccggcaacatcctgttcagcttccccgtgaagagcggcaccgaggactactgccagatccagcacttcaacagccccatggtgagcgagagcctgcagtacagctgcggcggcgagagcaagctgctgctgatcaagggcagcctgatcagcgtgggcccctacgactacagaaacaagaccggcggcagcagcaccgtggtgaaccccgccgaggacagctggagcatcttcaactggctgagcggcttcctggactggctgggcggccccctgagagccctggtgaagatcgccctggccatcatcggcgccctggccctgctgttcatcaccatcatgctggccagaagcgtgatcagcaacaccctgagcagaaagaagaagaactga

SEQ ID NO: 9447 - RNA, 3594 nt, synthetic construct
  misc_feature 1..3594: note = derived and/or modified CDS sequence (opt4) from RVFV(ZH-548)__DQ380206.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9448 - RNA, 3594 nt, synthetic construct
  misc_feature 1..3594: note = derived and/or modified CDS sequence (opt4) from RVFV(ZS-6365)__DQ380205.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9449 - RNA, 3594 nt, synthetic construct
  misc_feature 1..3594: note = derived and/or modified CDS sequence (opt4) from RVFV(CAR-R1622)__DQ380219.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9450 - RNA, 3594 nt, synthetic construct
  misc_feature 1..3594: note = derived and/or modified CDS sequence (opt4) from RVFV(2250/74)__DQ380209.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccaaggtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9451 - RNA, 3594 nt, synthetic construct
  misc_feature 1..3594: note = derived and/or modified CDS sequence (opt4) from RVFV(T1)__DQ380201.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9452 - RNA, 3594 nt, synthetic construct
  misc_feature 1..3594: note = derived and/or modified CDS sequence (opt4) from RVFV(1853/78)__DQ380220.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9453 - RNA, 3594 nt, synthetic construct
  misc_feature 1..3594: note = derived and/or modified CDS sequence (opt4) from RVFV(MP-12)__DQ380208.1__GP
  source 1..3594: mol_type = other RNA
atgtacgtgctgctgaccatcctgaccagcgtgctggtgtgcgaggccatcatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9454 - RNA, 3594 nt, synthetic construct
  misc_feature 1..3594: note = derived and/or modified CDS sequence (opt4) from RVFV(ZM-657)__DQ380204.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaaggcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9455 - RNA, 3594 nt, synthetic construct
  misc_feature 1..3594: note = derived and/or modified CDS sequence (opt4) from RVFV(ZH-501-777)__DQ380202.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggaccccggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9456 - RNA, 3594 nt, synthetic construct
  misc_feature 1..3594: note = derived and/or modified CDS sequence (opt4) from RVFV(OS-3)__DQ380184.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9457 - RNA, 3594 nt, synthetic construct
  misc_feature 1..3594: note = derived and/or modified CDS sequence (opt4) from RVFV(Sudan 86-2010)__JQ820489.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtgatcttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9458 - RNA, 3594 nt, synthetic construct
  misc_feature 1..3594: note = derived and/or modified CDS sequence (opt4) from RVFV(T-46 (228113))__DQ380199.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccaaggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9459 - RNA, 3594 nt, synthetic construct
  misc_feature 1..3594: note = derived and/or modified CDS sequence (opt4) from RVFV(2007000094)__EU574055.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9460 - RNA, 3594 nt, synthetic construct
  misc_feature 1..3594: note = derived and/or modified CDS sequence (opt4) from RVFV(ZC-3349)__DQ380207.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccaggccgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccacgtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgaaggcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9461 - RNA, 3594 nt, synthetic construct
  misc_feature 1..3594: note = derived and/or modified CDS sequence (opt4) from RVFV(2007001602)__EU574043.1__GP
  source 1..3594: mol_type = other RNA
atgtacgtgctgctgaccatcctgatcagcgtgctggtgtgcgaggccgtgatcagagtgagcatcagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9462 - RNA, 3594 nt, synthetic construct
  misc_feature 1..3594: note = derived and/or modified CDS sequence (opt4) from RVFV(1260/78)__DQ380214.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgcacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9463 - RNA, 3594 nt, synthetic construct
  misc_feature 1..3594: note = derived and/or modified CDS sequence (opt4) from RVFV(2007000324)__JF326195.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9464 - RNA, 3594 nt, synthetic construct
  misc_feature 1..3594: note = derived and/or modified CDS sequence (opt4) from RVFV(KEN/Gar-Msq/131B-04/06)__HM586972.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcttcagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9465 - RNA, 3594 nt, synthetic construct
  misc_feature 1..3594: note = derived and/or modified CDS sequence (opt4) from RVFV(2007004194)__EU574031.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgagcaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9466 - RNA, 3594 nt, synthetic construct
  misc_feature 1..3594: note = derived and/or modified CDS sequence (opt4) from RVFV(73HB1230)__DQ380221.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcaggtgggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagaaggagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccatcatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9467 - RNA, 3594 nt, synthetic construct
  misc_feature 1..3594: note = derived and/or modified CDS sequence (opt4) from RVFV(73HB1449)__DQ380211.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9468 - RNA, 3594 nt, synthetic construct
  misc_feature 1..3594: note = derived and/or modified CDS sequence (opt4) from RVFV(ZH-548M12)__M25276.1__GP
  source 1..3594: mol_type = other RNA
atgtacgtgctgctgaccatcctgaccagcgtgctggtgtgcgaggccatcatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagaaagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9469 - RNA, 3594 nt, synthetic construct
  misc_feature 1..3594: note = derived and/or modified CDS sequence (opt4) from RVFV(ZINGA J83 R1)__KU978776.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagactgatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9470 - RNA, 3594 nt, synthetic construct
  misc_feature 1..3594: note = derived and/or modified CDS sequence (opt4) from RVFV(Sudan 28-2010)__JQ820491.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggtgctgagcatcggcctgttcttcctgctgatctacctgggcagaaccggcctgagcaagatgtggctggccgccaccaagaaggccagctga

SEQ ID NO: 9471 - RNA, 3594 nt, synthetic construct
  misc_feature 1..3594: note = derived and/or modified CDS sequence (opt4) from RVFV(2007001292)__EU574046.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacctgttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9472 - RNA, 3594 nt, synthetic construct
  misc_feature 1..3594: note = derived and/or modified CDS sequence (opt4) from RVFV(Sudan 85-2010)__JQ820488.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9473 - RNA, 3594 nt, synthetic construct
  misc_feature 1..3594: note = derived and/or modified CDS sequence (opt4) from RVFV(2007002060)__EU574039.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaaaggacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9474 - RNA, 3594 nt, synthetic construct
  misc_feature 1..3594: note = derived and/or modified CDS sequence (opt4) from RVFV(2007002476)__EU574036.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcaagtgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9475 - RNA, 3594 nt, synthetic construct
  misc_feature 1..3594: note = derived and/or modified CDS sequence (opt4) from RVFV(2269/74)__DQ380222.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagcacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9476 - RNA, 3594 nt, synthetic construct
  misc_feature 1..3594: note = derived and/or modified CDS sequence (opt4) from RVFV(SA-51 (Van Wyck))__DQ380195.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggcagaggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggaggtgaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9477 - RNA, 3594 nt, synthetic construct
  misc_feature 1..3594: note = derived and/or modified CDS sequence (opt4) from RVFV(OS-8)__DQ380185.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgagaatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgagcggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9478 - RNA, 3594 nt, synthetic construct
  misc_feature 1..3594: note = derived and/or modified CDS sequence (opt4) from RVFV(BIME-01)__KX609032.1__GP
  source 1..3594: mol_type = other RNA
atgtacgtgctgctgaccatcctgatcagcgtgctggtgtgcgaggccatcatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9479 - RNA, 3594 nt, synthetic construct
  misc_feature 1..3594: note = derived and/or modified CDS sequence (opt4) from RVFV(Kenya 83 (21445))__DQ380198.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaagaaccccgagaacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9480 - RNA, 3594 nt, synthetic construct
  misc_feature 1..3594: note = derived and/or modified CDS sequence (opt4) from RVFV(2007000253)__JF326192.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgccggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9481 - RNA, 3594 nt, synthetic construct
  misc_feature 1..3594: note = derived and/or modified CDS sequence (opt4) from RVFV(200803166)__JF311381.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctgaagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccaccgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacgtggtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9482 - RNA, 3594 nt, synthetic construct
  misc_feature 1..3594: note = derived and/or modified CDS sequence (opt4) from RVFV(2007001107)__EU574047.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcaaccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9483 - RNA, 3594 nt, synthetic construct
  misc_feature 1..3594: note = derived and/or modified CDS sequence (opt4) from RVFV(ANK-3837)__DQ380215.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9484 - RNA, 3594 nt, synthetic construct
  misc_feature 1..3594: note = derived and/or modified CDS sequence (opt4) from RVFV(OS-1)__DQ380186.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagacagagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgaaggtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9485 - RNA, 3594 nt, synthetic construct
  misc_feature 1..3594: note = derived and/or modified CDS sequence (opt4) from RVFV(Sudan 2V-2007)__JQ820490.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcagcgtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagccacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatggccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9486 - RNA, 3594 nt, synthetic construct
  misc_feature 1..3594: note = derived and/or modified CDS sequence (opt4) from RVFV(200803162)__JF311377.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcgccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgagaaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9487 - RNA, 3594 nt, synthetic construct
  misc_feature 1..3594: note = derived and/or modified CDS sequence (opt4) from RVFV(2007001811)__EU574040.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgatgatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9488 - RNA, 3594 nt, synthetic construct
  misc_feature 1..3594: note = derived and/or modified CDS sequence (opt4) from RVFV(clone 13)__DQ380213.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9489 - RNA, 3594 nt, synthetic construct
  misc_feature 1..3594: note = derived and/or modified CDS sequence (opt4) from RVFV(MP12)__Z30318.1__GP
  source 1..3594: mol_type = other RNA
atgtacgtgctgctgaccatcctgaccagcgtgctggtgtgcgaggccatcatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagaaagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggcccacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9490 - RNA, 3594 nt, synthetic construct
  misc_feature 1..3594: note = derived and/or modified CDS sequence (opt4) from RVFV__JQ068143.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatcgacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9491 - RNA, 3594 nt, synthetic construct
  misc_feature 1..3594: note = derived and/or modified CDS sequence (opt4) from RVFV(2007002445)__EU574037.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcatccaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9492 - RNA, 3594 nt, synthetic construct
  misc_feature 1..3594: note = derived and/or modified CDS sequence (opt4) from RVFV(2008/00101)__HE687306.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccaccctgctgatctgcctgtacgtggccctgagcatcggcctgttcttcctgctgatctacctgggcagaaccggcctgagcaagatgtggctggccgccaccaagaaggccagctga

SEQ ID NO: 9493 - RNA, 3594 nt, synthetic construct
  misc_feature 1..3594: note = derived and/or modified CDS sequence (opt4) from RVFV(Hv-B375)__DQ380218.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagagggcgagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagaacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9494 - RNA, 3594 nt, synthetic construct
  misc_feature 1..3594: note = derived and/or modified CDS sequence (opt4) from RVFV(763/70)__DQ380188.1__GP
  source 1..3594: mol_type = other RNA
atgtacgtgctgctgaccatcctgatcaccgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctggtgaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacggcctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9495 - RNA, 3594 nt, synthetic construct
  misc_feature 1..3594: note = derived and/or modified CDS sequence (opt4) from RVFV(RVFBJ01/2016)__KX785331.1__GP
  source 1..3594: mol_type = other RNA
atgtacgtgctgctgaccatcctgatcagcgtgctggtgtgcgaggccatcatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9496 - RNA, 3594 nt, synthetic construct
  misc_feature 1..3594: note = derived and/or modified CDS sequence (opt4) from RVFV(Lunyo)__KU167026.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggtgagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccagatgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9497 - RNA, 3594 nt, synthetic construct
  misc_feature 1..3594: note = derived and/or modified CDS sequence (opt4) from RVFV(2007000234)__JF326191.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcagaagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9498 - RNA, 3594 nt, synthetic construct
  misc_feature 1..3594: note = derived and/or modified CDS sequence (opt4) from RVFV(KEN07-KUR340)__EF460404.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagaatgctgaagtgcctgaagatcgcccccagaatcgtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9499 - RNA, 3594 nt, synthetic construct
  misc_feature 1..3594: note = derived and/or modified CDS sequence (opt4) from RVFV(2373/74)__DQ380194.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgctacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatggtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccctggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9500 - RNA, 3594 nt, synthetic construct
  misc_feature 1..3594: note = derived and/or modified CDS sequence (opt4) from RVFV(200803169)__JF311384.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggtggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgaggtgagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9501 - RNA, 3594 nt, synthetic construct
  misc_feature 1..3594: note = derived and/or modified CDS sequence (opt4) from RVFV(200803167)__JF311382.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacctgcacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcgccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatgctgctgatctgcctgtacgtggccctgagcatcggcctgttcttcctgctgatctacctgggcagaaccggcctgagcaagatgtggctggccgccaccaagaaggccagctga

SEQ ID NO: 9502 - RNA, 3594 nt, synthetic construct
  misc_feature 1..3594: note = derived and/or modified CDS sequence (opt4) from RVFV(Entebbe)__DQ380191.1__GP
  source 1..3594: mol_type = other RNA
atgtacgccctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgcacagagccctgaaggccatcatcgccgccgacggcctgaacaacatcacctgccacggcaaggaccccgaggacaagatcagcctgatcaagggccccccccacaagaagagagtgggcgtggtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9503 - RNA, 3594 nt, synthetic construct
  misc_feature 1..3594: note = derived and/or modified CDS sequence (opt4) from RVFV(25010-24)__KM210509.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagagagcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcaggtgggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctgatcgtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9504 - RNA, 3594 nt, synthetic construct
  misc_feature 1..3594: note = derived and/or modified CDS sequence (opt4) from RVFV(Kenya 9800523)__DQ380196.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacaccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgaacgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggagggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9505 - RNA, 3594 nt, synthetic construct
  misc_feature 1..3594: note = derived and/or modified CDS sequence (opt4) from RVFV(ANK-6087)__DQ380216.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcagcaccaacctgatcgaccccttcgtggtgttcaagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9506 - RNA, 3594 nt, synthetic construct
  misc_feature 1..3594: note = derived and/or modified CDS sequence (opt4) from RVFV(SAUDI 200010901)__KU978778.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcggcagaagaagagacaccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9507 - RNA, 3594 nt, synthetic construct
  misc_feature 1..3594: note = derived and/or modified CDS sequence (opt4) from RVFV(35/74)__JF784387.1__GP
  source 1..3594: mol_type = other RNA
atgtacgtgctgctgaccatcctgatcaccgtgctggtgtgcgaggccgtgatcagagtgagcctgagcagcaccagagaggagacctgcttcggcgactacaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctggtgaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctggaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9508 - RNA, 3594 nt, synthetic construct
  misc_feature 1..3594: note = derived and/or modified CDS sequence (opt4) from RVFV(KEN/Kil-006/07)__HM586966.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcgtggtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9509 - RNA, 3594 nt, synthetic construct
  misc_feature 1..3594: note = derived and/or modified CDS sequence (opt4) from RVFV(MgH824)__DQ380210.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggctacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagagaaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccacccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtggacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttccccgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9510 - RNA, 3594 nt, synthetic construct
  misc_feature 1..3594: note = derived and/or modified CDS sequence (opt4) from RVFV(Kenya 57 (Rintoul))__DQ380192.1__GP
  source 1..3594: mol_type = other RNA
atgtacgccctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgcacagagccctgaaggccatcatcgccgccgacggcctgaacaacatcacctgccacggcaaggaccccgaggacaagatcagcctgatcaagggccccccccacaagaagagagtgggcgtggtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatcagcagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9511 - RNA, 3594 nt, synthetic construct
  misc_feature 1..3594: note = derived and/or modified CDS sequence (opt4) from RVFV(SA-75)__DQ380189.1__GP
  source 1..3594: mol_type = other RNA
atgtacgtgctgctgaccatcctgatcaccgtgctggtgtgcgaggccgtgatcagagtgagcctgagcagcaccagagaggagacctgcttcggcgactacaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctggtgaagggccccccccacaagaagagagtgggcatcgtgagatgcgagagaagaagagacgccaagcagatcggcagagagaccatggccagaatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9512 - RNA, 3594 nt, synthetic construct
  misc_feature 1..3594: note = derived and/or modified CDS sequence (opt4) from RVFV(SA01-1322)__KX096942.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcggcagaagaagagacaccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcgaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9513 - RNA, 3594 nt, synthetic construct
  misc_feature 1..3594: note = derived and/or modified CDS sequence (opt4) from RVFV(KEN/Mal-032/07)__HM586967.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9514 - RNA, 3594 nt, synthetic construct
  misc_feature 1..3594: note = derived and/or modified CDS sequence (opt4) from RVFV(KEN/Gar-008/06)__HM586965.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacctgaaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtgaaggaggagttcatgtacagctgcgacggcgacgagagagccctgctgatgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9515 - RNA, 3594 nt, synthetic construct
  misc_feature 1..3594: note = derived and/or modified CDS sequence (opt4) from RVFV(Kenya 56 (IB8))__DQ380190.1__GP
  source 1..3594: mol_type = other RNA
atgtacgtgctgctgaccatcctgatcaccgtgctggtgtgcgaggccgtgatcagagtgagcctgagcagcaccagagaggagacctgcttcggcgacagcaccagccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagcaggtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccagggcgacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaaggactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagagacccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatgagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagcccgccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggccttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9516 - RNA, 3594 nt, synthetic construct
  misc_feature 1..3594: note = derived and/or modified CDS sequence (opt4) from RVFV(KEN/Bar-035/07)__HM586969.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccagaagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9517 - RNA, 3594 nt, synthetic construct
  misc_feature 1..3594: note = derived and/or modified CDS sequence (opt4) from RVFV(TAN/Dod-002/07)__HM586971.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccaggcctggatcatcagccagtggcacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9518 - RNA, 3594 nt, synthetic construct
  misc_feature 1..3594: note = derived and/or modified CDS sequence (opt4) from RVFV(Beijing-01)__KX611606.1__GP
  source 1..3594: mol_type = other RNA
atgtacgtgctgctgaccatcctgatcagcgtgctggtgttcgaggtggtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcgtgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggcagactgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtgttcgactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgttcgagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9519 - RNA, 3594 nt, synthetic construct
  misc_feature 1..3594: note = derived and/or modified CDS sequence (opt4) from RVFV(Smithburn)__DQ380193.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccaccatcgccgccgacggcctgaacaacatcacctgccacggcaaggaccccgaggacaagatcagcctgatcaagggccccccccacaagaagagagtgggcgtggtgagatgcgagagacagagagacgccaagcagatcggcagaggcaccatggccggcatcgccatgaccgtgttccccgccctggtggtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacatcatcatcgccaaggccgacccccccagctgcaacctgcagagcgcccacggcaacccctgcatgaaggagaagctggtgatgaagacctactgccccaacgactaccagagcgcccactacctgaacaacgacggcaagatggccagcgtgaagtgcccccccaagcacgagctgaccgaggactgcaacttctgcagacagatgaccggcgccagcctgaaggagggcagctaccccctgcaggacctgttctgccagagcagcgaggacgacggcagcaagctgaagaccaagatgaagggcgtgtgcgaggtgggcgtgcaggtgctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccttcagcgccttcgtggtggtgttcgtgttcagcagcgtggtgatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcttcctgatctacctgggcagaaccggcctgagcaagatgtggctggccgccaccaagaaggccagctga

SEQ ID NO: 9520 - RNA, 3594 nt, synthetic construct
  misc_feature 1..3594: note = derived and/or modified CDS sequence (opt4) from RVFV(KEN/Bar-032/07)__HM586968.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcgtgggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagccacaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9521 - RNA, 3594 nt, synthetic construct
  misc_feature 1..3594: note = derived and/or modified CDS sequence (opt4) from RVFV(KEN/Gar-004/06)__HM586964.1__GP
  source 1..3594: mol_type = other RNA
atgtacgtgctgctgaccatcctgatcagcgtgtgggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagccagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagagaaccggcgacgccgccttctgcagcgcctacgagtgcaccgcccagtacgccaacgcctactgcagcagagccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaacaaccagagccacagcgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9522 - RNA, 3621 nt, synthetic construct
  misc_feature 1..3621: note = derived and/or modified CDS sequence (opt4) from RVFV(RVFV)__M11157.1__GP
  source 1..3621: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacggcctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggcccacaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggcccacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcatcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccagcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagctgtacagcagcttcgcctgcatgctgcactaccagctgggcagcttcagcagcctgtacatcctggaggagcaggccagcctgaagtgcggcctgctgcccctgagaagaccccacagaagcgtgagagtgaaggtgatctgctga

SEQ ID NO: 9523 - RNA, 3480 nt, synthetic construct
  misc_feature 1..3480: note = derived and/or modified CDS sequence (opt4) from RVFV(ZH-548)__DQ380206.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9524 - RNA, 3480 nt, synthetic construct
  misc_feature 1..3480: note = derived and/or modified CDS sequence (opt4) from RVFV(ZS-6365)__DQ380205.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9525 - RNA, 3480 nt, synthetic construct
  misc_feature 1..3480: note = derived and/or modified CDS sequence (opt4) from RVFV(MP-12)__DQ380208.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9526 - RNA, 3480 nt, synthetic construct
  misc_feature 1..3480: note = derived and/or modified CDS sequence (opt4) from RVFV(T1)__DQ380201.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9527 - RNA, 3480 nt, synthetic construct
  misc_feature 1..3480: note = derived and/or modified CDS sequence (opt4) from RVFV(1853/78)__DQ380220.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9528 - RNA, 3480 nt, synthetic construct
  misc_feature 1..3480: note = derived and/or modified CDS sequence (opt4) from RVFV(CAR-R1622)__DQ380219.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9529 - RNA, 3480 nt, synthetic construct
  misc_feature 1..3480: note = derived and/or modified CDS sequence (opt4) from RVFV(2250/74)__DQ380209.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccaaggtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9530 - RNA, 3480 nt, synthetic construct
  misc_feature 1..3480: note = derived and/or modified CDS sequence (opt4) from RVFV(2007000094)__EU574055.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9531 - RNA, 3480 nt, synthetic construct
  misc_feature 1..3480: note = derived and/or modified CDS sequence (opt4) from RVFV(ZM-657)__DQ380204.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaaggcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9532 - RNA, 3480 nt, synthetic construct
  misc_feature 1..3480: note = derived and/or modified CDS sequence (opt4) from RVFV(ZH-548M12)__M25276.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagaaagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9533 - RNA, 3480 nt, synthetic construct
  misc_feature 1..3480: note = derived and/or modified CDS sequence (opt4) from RVFV(ZH-501-777)__DQ380202.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggaccccggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9534 - RNA, 3480 nt, synthetic construct
  misc_feature 1..3480: note = derived and/or modified CDS sequence (opt4) from RVFV(T-46 (228113))__DQ380199.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccaaggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9535 - RNA, 3480 nt, synthetic construct
  misc_feature 1..3480: note = derived and/or modified CDS sequence (opt4) from RVFV(OS-3)__DQ380184.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9536 - RNA, 3480 nt, synthetic construct
  misc_feature 1..3480: note = derived and/or modified CDS sequence (opt4) from RVFV(Sudan 86-2010)__JQ820489.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtgatcttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9537 - RNA, 3480 nt, synthetic construct
  misc_feature 1..3480: note = derived and/or modified CDS sequence (opt4) from RVFV(Sudan 28-2010)__JQ820491.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggtgctgagcatcggcctgttcttcctgctgatctacctgggcagaaccggcctgagcaagatgtggctggccgccaccaagaaggccagctga

SEQ ID NO: 9538 - RNA, 3480 nt, synthetic construct
  misc_feature 1..3480: note = derived and/or modified CDS sequence (opt4) from RVFV(2007004194)__EU574031.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgagcaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9539 - RNA, 3480 nt, synthetic construct
  misc_feature 1..3480: note = derived and/or modified CDS sequence (opt4) from RVFV(73HB1230)__DQ380221.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcaggtgggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagaaggagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccatcatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9540 - RNA, 3480 nt, synthetic construct
  misc_feature 1..3480: note = derived and/or modified CDS sequence (opt4) from RVFV(1260/78)__DQ380214.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgcacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9541 - RNA, 3480 nt, synthetic construct
  misc_feature 1..3480: note = derived and/or modified CDS sequence (opt4) from RVFV(ZC-3349)__DQ380207.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccaggccgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccacgtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgaaggcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9542 - RNA, 3480 nt, synthetic construct
  misc_feature 1..3480: note = derived and/or modified CDS sequence (opt4) from RVFV(Sudan 85-2010)__JQ820488.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9543 - RNA, 3480 nt, synthetic construct
  misc_feature 1..3480: note = derived and/or modified CDS sequence (opt4) from RVFV(2007000324)__JF326195.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9544 - RNA, 3480 nt, synthetic construct
  misc_feature 1..3480: note = derived and/or modified CDS sequence (opt4) from RVFV(OS-8)__DQ380185.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgagaatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgagcggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9545 - RNA, 3480 nt, synthetic construct
  misc_feature 1..3480: note = derived and/or modified CDS sequence (opt4) from RVFV(ZINGA J83 R1)__KU978776.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagactgatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9546 - RNA, 3480 nt, synthetic construct
  misc_feature 1..3480: note = derived and/or modified CDS sequence (opt4) from RVFV(2007000253)__JF326192.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgccggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9547 - RNA, 3480 nt, synthetic construct
  misc_feature 1..3480: note = derived and/or modified CDS sequence (opt4) from RVFV(MP12)__Z30318.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagaaagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggcccacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9548 - RNA, 3480 nt, synthetic construct
  misc_feature 1..3480: note = derived and/or modified CDS sequence (opt4) from RVFV(BIME-01)__KX609032.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9549 - RNA, 3480 nt, synthetic construct
  misc_feature 1..3480: note = derived and/or modified CDS sequence (opt4) from RVFV(200803166)__JF311381.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctgaagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccaccgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacgtggtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9550 - RNA, 3480 nt, synthetic construct
  misc_feature 1..3480: note = derived and/or modified CDS sequence (opt4) from RVFV(Kenya 83 (21445))__DQ380198.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaagaaccccgagaacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9551 - RNA, 3480 nt, synthetic construct
  misc_feature 1..3480: note = derived and/or modified CDS sequence (opt4) from RVFV(Entebbe)__DQ380191.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgcacagagccctgaaggccatcatcgccgccgacggcctgaacaacatcacctgccacggcaaggaccccgaggacaagatcagcctgatcaagggccccccccacaagaagagagtgggcgtggtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9552 - RNA, 3480 nt, synthetic construct
  misc_feature 1..3480: note = derived and/or modified CDS sequence (opt4) from RVFV(763/70)__DQ380188.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctggtgaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacggcctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9553 - RNA, 3480 nt, synthetic construct
  misc_feature 1..3480: note = derived and/or modified CDS sequence (opt4) from RVFV(OS-1)__DQ380186.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagacagagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgaaggtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9554 - RNA, 3480 nt, synthetic construct
  misc_feature 1..3480: note = derived and/or modified CDS sequence (opt4) from RVFV(2008/00101)__HE687306.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccaccctgctgatctgcctgtacgtggccctgagcatcggcctgttcttcctgctgatctacctgggcagaaccggcctgagcaagatgtggctggccgccaccaagaaggccagctga

SEQ ID NO: 9555 - RNA, 3480 nt, synthetic construct
  misc_feature 1..3480: note = derived and/or modified CDS sequence (opt4) from RVFV(200803162)__JF311377.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcgccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgagaaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9556 - RNA, 3480 nt, synthetic construct
  misc_feature 1..3480: note = derived and/or modified CDS sequence (opt4) from RVFV(2007002060)__EU574039.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaaaggacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9557 - RNA, 3480 nt, synthetic construct
  misc_feature 1..3480: note = derived and/or modified CDS sequence (opt4) from RVFV(2007002476)__EU574036.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcaagtgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9558 - RNA, 3480 nt, synthetic construct
  misc_feature 1..3480: note = derived and/or modified CDS sequence (opt4) from RVFV(2269/74)__DQ380222.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagcacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9559 - RNA, 3480 nt, synthetic construct
  misc_feature 1..3480: note = derived and/or modified CDS sequence (opt4) from RVFV(73HB1449)__DQ380211.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9560 - RNA, 3480 nt, synthetic construct
  misc_feature 1..3480: note = derived and/or modified CDS sequence (opt4) from RVFV(SA-51 (Van Wyck))__DQ380195.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggcagaggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggaggtgaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9561 - RNA, 3480 nt, synthetic construct
  misc_feature 1..3480: note = derived and/or modified CDS sequence (opt4) from RVFV(KEN/Gar-Msq/131B-04/06)__HM586972.1__NSm-Gn-Gc
  source 1..3480: mol_type = other RNA
atgatcgagggcgcctgggacagcttcagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9562 - RNA, 3480 nt, synthetic construct
  misc_feature 1..3480: note = derived and/or modified CDS sequence (opt4) from RVFV(2007001107)__EU574047.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcaaccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9563 - RNA, 3480 nt, synthetic construct
  misc_feature 1..3480: note = derived and/or modified CDS sequence (opt4) from RVFV(ANK-3837)__DQ380215.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9564 - RNA, 3480 nt, synthetic construct
  misc_feature 1..3480: note = derived and/or modified CDS sequence (opt4) from RVFV(Lunyo)__KU167026.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggtgagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccagatgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9565 - RNA, 3480 nt, synthetic construct
  misc_feature 1..3480: note = derived and/or modified CDS sequence (opt4) from RVFV(RVFBJ01/2016)__KX785331.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9566 - RNA, 3480 nt, synthetic construct
  misc_feature 1..3480: note = derived and/or modified CDS sequence (opt4) from RVFV(Ken 199800523)__KU978777.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacaccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgaacgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggagggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9567 - RNA, 3480 nt, synthetic construct
  misc_feature 1..3480: note = derived and/or modified CDS sequence (opt4) from RVFV__JQ068143.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatcgacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9568 - RNA, 3480 nt, synthetic construct
  misc_feature 1..3480: note = derived and/or modified CDS sequence (opt4) from RVFV(200803169)__JF311384.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggtggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgaggtgagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9569 - RNA, 3480 nt, synthetic construct
  misc_feature 1..3480: note = derived and/or modified CDS sequence (opt4) from RVFV(2007002445)__EU574037.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcatccaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9570 - RNA, 3480 nt, synthetic construct
  misc_feature 1..3480: note = derived and/or modified CDS sequence (opt4) from RVFV(Hv-B375)__DQ380218.1__NSm-Gn-Gc
  source 1..3480: mol_type = other RNA
atgatcgagggcgcctgggacagcctgagagagggcgagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagaacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9571 - RNA, 3480 nt, synthetic construct
  misc_feature 1..3480: note = derived and/or modified CDS sequence (opt4) from RVFV(clone 13)__DQ380213.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9572 - RNA, 3480 nt, synthetic construct
  misc_feature 1..3480: note = derived and/or modified CDS sequence (opt4) from RVFV(Kenya 57 (Rintoul))__DQ380192.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgcacagagccctgaaggccatcatcgccgccgacggcctgaacaacatcacctgccacggcaaggaccccgaggacaagatcagcctgatcaagggccccccccacaagaagagagtgggcgtggtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatcagcagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9573 - RNA, 3480 nt, synthetic construct
  misc_feature 1..3480: note = derived and/or modified CDS sequence (opt4) from RVFV(2007001292)__EU574046.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacctgttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9574 - RNA, 3480 nt, synthetic construct
  misc_feature 1..3480: note = derived and/or modified CDS sequence (opt4) from RVFV(2007001811)__EU574040.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgatgatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9575 - RNA, 3480 nt, synthetic construct
  misc_feature 1..3480: note = derived and/or modified CDS sequence (opt4) from RVFV(ANK-6087)__DQ380216.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcagcaccaacctgatcgaccccttcgtggtgttcaagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9576 - RNA, 3480 nt, synthetic construct
  misc_feature 1..3480: note = derived and/or modified CDS sequence (opt4) from RVFV(2007000234)__JF326191.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcagaagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9577 - RNA, 3480 nt, synthetic construct
  misc_feature 1..3480: note = derived and/or modified CDS sequence (opt4) from RVFV(SA-75)__DQ380189.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctggtgaagggccccccccacaagaagagagtgggcatcgtgagatgcgagagaagaagagacgccaagcagatcggcagagagaccatggccagaatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9578 - RNA, 3480 nt, synthetic construct
  misc_feature 1..3480: note = derived and/or modified CDS sequence (opt4) from RVFV(KEN07-KUR340)__EF460404.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagaatgctgaagtgcctgaagatcgcccccagaatcgtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9579 - RNA, 3480 nt, synthetic construct
  misc_feature 1..3480: note = derived and/or modified CDS sequence (opt4) from RVFV(35/74)__JF784387.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctggtgaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctggaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9580 - RNA, 3480 nt, synthetic construct
  misc_feature 1..3480: note = derived and/or modified CDS sequence (opt4) from RVFV(200803167)__JF311382.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacctgcacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcgccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatgctgctgatctgcctgtacgtggccctgagcatcggcctgttcttcctgctgatctacctgggcagaaccggcctgagcaagatgtggctggccgccaccaagaaggccagctga

SEQ ID NO: 9581 - RNA, 3480 nt, synthetic construct
  misc_feature 1..3480: note = derived and/or modified CDS sequence (opt4) from RVFV(25010-24)__KM210509.1__NSm-Gn-Gc
  source 1..3480: mol_type = other RNA
atgatcgagagagcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcaggtgggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctgatcgtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9582 - RNA, 3480 nt, synthetic construct
  misc_feature 1..3480: note = derived and/or modified CDS sequence (opt4) from RVFV(Sudan 2V-2007)__JQ820490.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcagcgtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagccacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatggccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9583 - RNA, 3480 nt, synthetic construct
  misc_feature 1..3480: note = derived and/or modified CDS sequence (opt4) from RVFV(SAUDI 200010901)__KU978778.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcggcagaagaagagacaccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9584 - RNA, 3480 nt, synthetic construct
  misc_feature 1..3480: note = derived and/or modified CDS sequence (opt4) from RVFV(2373/74)__DQ380194.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgctacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatggtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccctggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9585 - RNA, 3480 nt, synthetic construct
  misc_feature 1..3480: note = derived and/or modified CDS sequence (opt4) from RVFV(KEN/Kil-006/07)__HM586966.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcgtggtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9586 - RNA, 3480 nt, synthetic construct
  misc_feature 1..3480: note = derived and/or modified CDS sequence (opt4) from RVFV(MgH824)__DQ380210.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggctacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagagaaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccacccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtggacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttccccgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9587 - RNA, 3480 nt, synthetic construct
  misc_feature 1..3480: note = derived and/or modified CDS sequence (opt4) from RVFV(SA01-1322)__KX096942.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcggcagaagaagagacaccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcgaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9588 - RNA, 3480 nt, synthetic construct
  misc_feature 1..3480: note = derived and/or modified CDS sequence (opt4) from RVFV(Kenya 56 (IB8))__DQ380190.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagcaggtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccagggcgacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaaggactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagagacccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatgagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagcccgccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggccttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9589 - RNA, 3480 nt, synthetic construct
  misc_feature 1..3480: note = derived and/or modified CDS sequence (opt4) from RVFV(KEN/Mal-032/07)__HM586967.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9590 - RNA, 3480 nt, synthetic construct
  misc_feature 1..3480: note = derived and/or modified CDS sequence (opt4) from RVFV(KEN/Gar-008/06)__HM586965.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacctgaaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtgaaggaggagttcatgtacagctgcgacggcgacgagagagccctgctgatgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9591 - RNA, 3480 nt, synthetic construct
  misc_feature 1..3480: note = derived and/or modified CDS sequence (opt4) from RVFV(Beijing-01)__KX611606.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgccacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcgtgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggcagactgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtgttcgactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgttcgagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9592 - RNA, 3480 nt, synthetic construct
  misc_feature 1..3480: note = derived and/or modified CDS sequence (opt4) from RVFV(KEN/Bar-035/07)__HM586969.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccagaagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9593 - RNA, 3480 nt, synthetic construct
  misc_feature 1..3480: note = derived and/or modified CDS sequence (opt4) from RVFV(KEN/Bar-032/07)__HM586968.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcgtgggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagccacaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9594 - RNA, 3480 nt, synthetic construct
  misc_feature 1..3480: note = derived and/or modified CDS sequence (opt4) from RVFV(TAN/Dod-002/07)__HM586971.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccaggcctggatcatcagccagtggcacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9595 - RNA, 3480 nt, synthetic construct
  misc_feature 1..3480: note = derived and/or modified CDS sequence (opt4) from RVFV(Smithburn)__DQ380193.1__NSm-Gn-Gc
  source 1..3480: mol_type = other RNA
atgatcgagggcgcctgggacagcctgagagaggaggagatgcccgaggagctgagctgcagcatcagcggcatcagagaggtgaagaccagcagccaggagctgtacagagccctgaaggccaccatcgccgccgacggcctgaacaacatcacctgccacggcaaggaccccgaggacaagatcagcctgatcaagggccccccccacaagaagagagtgggcgtggtgagatgcgagagacagagagacgccaagcagatcggcagaggcaccatggccggcatcgccatgaccgtgttccccgccctggtggtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacatcatcatcgccaaggccgacccccccagctgcaacctgcagagcgcccacggcaacccctgcatgaaggagaagctggtgatgaagacctactgccccaacgactaccagagcgcccactacctgaacaacgacggcaagatggccagcgtgaagtgcccccccaagcacgagctgaccgaggactgcaacttctgcagacagatgaccggcgccagcctgaaggagggcagctaccccctgcaggacctgttctgccagagcagcgaggacgacggcagcaagctgaagaccaagatgaagggcgtgtgcgaggtgggcgtgcaggtgctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccttcagcgccttcgtggtggtgttcgtgttcagcagcgtggtgatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcttcctgatctacctgggcagaaccggcctgagcaagatgtggctggccgccaccaagaaggccagctga

SEQ ID NO: 9596 - RNA, 3480 nt, synthetic construct
  misc_feature 1..3480: note = derived and/or modified CDS sequence (opt4) from RVFV(KEN/Gar-004/06)__HM586964.1__NSm-Gn-Gc
  source 1..3480: mol_type = other RNA
atgatcgagggcgcctgggacagcctgagagaggaggagatgcccgaggagctgagctgcagcgtgagcggcatcagagaggtgaagaccagcagccaggagctgtacagagccctgaaggccatcatcgccgccgacggcctgaacaacatcacctgccacggcaagaaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagccagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagagaaccggcgacgccgccttctgcagcgcctacgagtgcaccgcccagtacgccaacgcctactgcagcagagccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaacaaccagagccacagcgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9597 - RNA, 3204 nt, synthetic construct
  misc_feature 1..3204: note = derived and/or modified CDS sequence (opt4) from RVFV(ZH-548)__DQ380206.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9598 - RNA, 3204 nt, synthetic construct
  misc_feature 1..3204: note = derived and/or modified CDS sequence (opt4) from RVFV(2007000094)__EU574055.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9599 - RNA, 3204 nt, synthetic construct
  misc_feature 1..3204: note = derived and/or modified CDS sequence (opt4) from RVFV(ZH-548M12)__M25276.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9600 - RNA, 3204 nt, synthetic construct
  misc_feature 1..3204: note = derived and/or modified CDS sequence (opt4) from RVFV(Sudan 86-2010)__JQ820489.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtgatcttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9601 - RNA, 3204 nt, synthetic construct
  misc_feature 1..3204: note = derived and/or modified CDS sequence (opt4) from RVFV(ZS-6365)__DQ380205.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9602 - RNA, 3204 nt, synthetic construct
  misc_feature 1..3204: note = derived and/or modified CDS sequence (opt4) from RVFV(1853/78)__DQ380220.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9603 - RNA, 3204 nt, synthetic construct
  misc_feature 1..3204: note = derived and/or modified CDS sequence (opt4) from RVFV(T1)__DQ380201.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9604 - RNA, 3204 nt, synthetic construct
  misc_feature 1..3204: note = derived and/or modified CDS sequence (opt4) from RVFV(Kenya 83 (21445))__DQ380198.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9605 - RNA, 3204 nt, synthetic construct
  misc_feature 1..3204: note = derived and/or modified CDS sequence (opt4) from RVFV(Sudan 85-2010)__JQ820488.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9606 - RNA, 3204 nt, synthetic construct
  misc_feature 1..3204: note = derived and/or modified CDS sequence (opt4) from RVFV(2007004194)__EU574031.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgagcaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9607 - RNA, 3204 nt, synthetic construct
  misc_feature 1..3204: note = derived and/or modified CDS sequence (opt4) from RVFV(2250/74)__DQ380209.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccaaggtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9608 - RNA, 3204 nt, synthetic construct
  misc_feature 1..3204: note = derived and/or modified CDS sequence (opt4) from RVFV(Sudan 28-2010)__JQ820491.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggtgctgagcatcggcctgttcttcctgctgatctacctgggcagaaccggcctgagcaagatgtggctggccgccaccaagaaggccagctga

SEQ ID NO: 9609 - RNA, 3204 nt, synthetic construct
  misc_feature 1..3204: note = derived and/or modified CDS sequence (opt4) from RVFV(2007000324)__JF326195.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9610 - RNA, 3204 nt, synthetic construct
  misc_feature 1..3204: note = derived and/or modified CDS sequence (opt4) from RVFV(ZM-657)__DQ380204.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaaggcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9611 - RNA, 3204 nt, synthetic construct
  misc_feature 1..3204: note = derived and/or modified CDS sequence (opt4) from RVFV(T-46 (228113))__DQ380199.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccaaggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9612 - RNA, 3204 nt, synthetic construct
  misc_feature 1..3204: note = derived and/or modified CDS sequence (opt4) from RVFV(MP12)__Z30318.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggcccacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagctga

SEQ ID NO: 9613 - RNA, 3204 nt, synthetic construct
  misc_feature 1..3204: note = derived and/or modified CDS sequence (opt4) from RVFV(200803166)__JF311381.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctgaagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccaccgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacgtggtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9614 - RNA, 3204 nt, synthetic construct
  misc_feature 1..3204: note = derived and/or modified CDS sequence (opt4) from RVFV(200803162)__JF311377.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcgccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgagaaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9615 - RNA, 3204 nt, synthetic construct
  misc_feature 1..3204: note = derived and/or modified CDS sequence (opt4) from RVFV(Hv-B375)__DQ380218.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagaacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9616 - RNA, 3204 nt, synthetic construct
  misc_feature 1..3204: note = derived and/or modified CDS sequence (opt4) from RVFV(1260/78)__DQ380214.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgcacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9617 - RNA, 3204 nt, synthetic construct
  misc_feature 1..3204: note = derived and/or modified CDS sequence (opt4) from RVFV(ZH-501-777)__DQ380202.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggaccccggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9618 - RNA, 3204 nt, synthetic construct
  misc_feature 1..3204: note = derived and/or modified CDS sequence (opt4) from RVFV(OS-3)__DQ380184.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9619 - RNA, 3204 nt, synthetic construct
  misc_feature 1..3204: note = derived and/or modified CDS sequence (opt4) from RVFV(SAUDI 200010901)__KU978778.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9620 - RNA, 3204 nt, synthetic construct
  misc_feature 1..3204: note = derived and/or modified CDS sequence (opt4) from RVFV(2007001811)__EU574040.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgatgatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9621 - RNA, 3204 nt, synthetic construct
  misc_feature 1..3204: note = derived and/or modified CDS sequence (opt4) from RVFV(2007000253)__JF326192.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgccggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9622 - RNA, 3204 nt, synthetic construct
  misc_feature 1..3204: note = derived and/or modified CDS sequence (opt4) from RVFV(2007001292)__EU574046.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacctgttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9623 - RNA, 3204 nt, synthetic construct
  misc_feature 1..3204: note = derived and/or modified CDS sequence (opt4) from RVFV(2007002476)__EU574036.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcaagtgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9624 - RNA, 3204 nt, synthetic construct
  misc_feature 1..3204: note = derived and/or modified CDS sequence (opt4) from RVFV(73HB1230)__DQ380221.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagaaggagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccatcatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9625 - RNA, 3204 nt, synthetic construct
  misc_feature 1..3204: note = derived and/or modified CDS sequence (opt4) from RVFV(ZINGA J83 R1)__KU978776.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagactgatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9626 - RNA, 3204 nt, synthetic construct
  misc_feature 1..3204: note = derived and/or modified CDS sequence (opt4) from RVFV(2008/00101)__HE687306.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccaccctgctgatctgcctgtacgtggccctgagcatcggcctgttcttcctgctgatctacctgggcagaaccggcctgagcaagatgtggctggccgccaccaagaaggccagctga

SEQ ID NO: 9627 - RNA, 3204 nt, synthetic construct
  misc_feature 1..3204: note = derived and/or modified CDS sequence (opt4) from RVFV(2007002445)__EU574037.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcatccaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9628 - RNA, 3204 nt, synthetic construct
  misc_feature 1..3204: note = derived and/or modified CDS sequence (opt4) from RVFV(ZC-3349)__DQ380207.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccaggccgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccacgtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgaaggcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9629 - RNA, 3204 nt, synthetic construct
  misc_feature 1..3204: note = derived and/or modified CDS sequence (opt4) from RVFV(Kenya 9800523)__DQ380196.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgaacgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggagggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9630 - RNA, 3204 nt, synthetic construct
  misc_feature 1..3204: note = derived and/or modified CDS sequence (opt4) from RVFV(Entebbe)__DQ380191.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9631 - RNA, 3204 nt, synthetic construct
  misc_feature 1..3204: note = derived and/or modified CDS sequence (opt4) from RVFV(25010-24)__KM210509.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctgatcgtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9632 - RNA, 3204 nt, synthetic construct
  misc_feature 1..3204: note = derived and/or modified CDS sequence (opt4) from RVFV(763/70)__DQ380188.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacggcctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9633 - RNA, 3204 nt, synthetic construct
  misc_feature 1..3204: note = derived and/or modified CDS sequence (opt4) from RVFV(OS-1)__DQ380186.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgaaggtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9634 - RNA, 3204 nt, synthetic construct
  misc_feature 1..3204: note = derived and/or modified CDS sequence (opt4) from RVFV(BIME-01)__KX609032.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9635 - RNA, 3204 nt, synthetic construct
  misc_feature 1..3204: note = derived and/or modified CDS sequence (opt4) from RVFV(73HB1449)__DQ380211.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9636 - RNA, 3204 nt, synthetic construct
  misc_feature 1..3204: note = derived and/or modified CDS sequence (opt4) from RVFV(SA01-1322)__KX096942.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcgaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9637 - RNA, 3204 nt, synthetic construct
  misc_feature 1..3204: note = derived and/or modified CDS sequence (opt4) from RVFV(Sudan 2V-2007)__JQ820490.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcagcgtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagccacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatggccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9638 - RNA, 3204 nt, synthetic construct
  misc_feature 1..3204: note = derived and/or modified CDS sequence (opt4) from RVFV(35/74)__JF784387.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctggaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9639 - RNA, 3204 nt, synthetic construct
  misc_feature 1..3204: note = derived and/or modified CDS sequence (opt4) from RVFV(200803169)__JF311384.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggtggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgaggtgagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9640 - RNA, 3204 nt, synthetic construct
  misc_feature 1..3204: note = derived and/or modified CDS sequence (opt4) from RVFV(2269/74)__DQ380222.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagcacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9641 - RNA, 3204 nt, synthetic construct
  misc_feature 1..3204: note = derived and/or modified CDS sequence (opt4) from RVFV(SA-51 (Van Wyck))__DQ380195.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggcagaggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggaggtgaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9642 - RNA, 3204 nt, synthetic construct
  misc_feature 1..3204: note = derived and/or modified CDS sequence (opt4) from RVFV(OS-8)__DQ380185.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgagaatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgagcggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9643 - RNA, 3204 nt, synthetic construct
  misc_feature 1..3204: note = derived and/or modified CDS sequence (opt4) from RVFV(KEN07-KUR340)__EF460404.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagaatgctgaagtgcctgaagatcgcccccagaatcgtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9644 - RNA, 3204 nt, synthetic construct
  misc_feature 1..3204: note = derived and/or modified CDS sequence (opt4) from RVFV(ANK-3837)__DQ380215.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9645 - RNA, 3204 nt, synthetic construct
  misc_feature 1..3204: note = derived and/or modified CDS sequence (opt4) from RVFV(Lunyo)__KU167026.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggtgagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccagatgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9646 - RNA, 3204 nt, synthetic construct
  misc_feature 1..3204: note = derived and/or modified CDS sequence (opt4) from RVFV(200803167)__JF311382.1__Gn-Gc
  source 1..3204: mol_type = other RNA
atggccggcatcgccatgaccgtgctgcccgccctggccgtgttcgccctggcccccgtggtgttcgccgaggacctgcacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcgccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatgctgctgatctgcctgtacgtggccctgagcatcggcctgttcttcctgctgatctacctgggcagaaccggcctgagcaagatgtggctggccgccaccaagaaggccagctga

SEQ ID NO: 9647 - RNA, 3204 nt, synthetic construct
  misc_feature 1..3204: note = derived and/or modified CDS sequence (opt4) from RVFV(2373/74)__DQ380194.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatggtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccctggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9648 - RNA, 3204 nt, synthetic construct
  misc_feature 1..3204: note = derived and/or modified CDS sequence (opt4) from RVFV(Kenya 57 (Rintoul))__DQ380192.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatcagcagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9649 - RNA, 3204 nt, synthetic construct
  misc_feature 1..3204: note = derived and/or modified CDS sequence (opt4) from RVFV(RVFBJ01/2016)__KX785331.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9650 - RNA, 3204 nt, synthetic construct
  misc_feature 1..3204: note = derived and/or modified CDS sequence (opt4) from RVFV(clone 13)__DQ380213.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9651 - RNA, 3204 nt, synthetic construct
  misc_feature 1..3204: note = derived and/or modified CDS sequence (opt4) from RVFV__JQ068143.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatcgacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9652 - RNA, 3204 nt, synthetic construct
  misc_feature 1..3204: note = derived and/or modified CDS sequence (opt4) from RVFV(SA-75)__DQ380189.1__Gn-Gc
  source 1..3204: mol_type = other RNA
atggccagaatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9653 - RNA, 3204 nt, synthetic construct
  misc_feature 1..3204: note = derived and/or modified CDS sequence (opt4) from RVFV(ANK-6087)__DQ380216.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcagcaccaacctgatcgaccccttcgtggtgttcaagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9654 - RNA, 3204 nt, synthetic construct
  misc_feature 1..3204: note = derived and/or modified CDS sequence (opt4) from RVFV(KEN/Kil-006/07)__HM586966.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9655 - RNA, 3204 nt, synthetic construct
  misc_feature 1..3204: note = derived and/or modified CDS sequence (opt4) from RVFV(MgH824)__DQ380210.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggctacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagagaaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccacccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtggacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttccccgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9656 - RNA, 3204 nt, synthetic construct
  misc_feature 1..3204: note = derived and/or modified CDS sequence (opt4) from RVFV(KEN/Mal-032/07)__HM586967.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9657 - RNA, 3204 nt, synthetic construct
  misc_feature 1..3204: note = derived and/or modified CDS sequence (opt4) from RVFV(Kenya 56 (IB8))__DQ380190.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccagggcgacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaaggactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagagacccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatgagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagcccgccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggccttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9658 - RNA, 3204 nt, synthetic construct
  misc_feature 1..3204: note = derived and/or modified CDS sequence (opt4) from RVFV(KEN/Gar-008/06)__HM586965.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacctgaaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtgaaggaggagttcatgtacagctgcgacggcgacgagagagccctgctgatgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9659 - RNA, 3204 nt, synthetic construct
  misc_feature 1..3204: note = derived and/or modified CDS sequence (opt4) from RVFV(KEN/Bar-035/07)__HM586969.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccagaagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9660 - RNA, 3204 nt, synthetic construct
  misc_feature 1..3204: note = derived and/or modified CDS sequence (opt4) from RVFV(Smithburn)__DQ380193.1__Gn-Gc
  source 1..3204: mol_type = other RNA
atggccggcatcgccatgaccgtgttccccgccctggtggtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacatcatcatcgccaaggccgacccccccagctgcaacctgcagagcgcccacggcaacccctgcatgaaggagaagctggtgatgaagacctactgccccaacgactaccagagcgcccactacctgaacaacgacggcaagatggccagcgtgaagtgcccccccaagcacgagctgaccgaggactgcaacttctgcagacagatgaccggcgccagcctgaaggagggcagctaccccctgcaggacctgttctgccagagcagcgaggacgacggcagcaagctgaagaccaagatgaagggcgtgtgcgaggtgggcgtgcaggtgctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccttcagcgccttcgtggtggtgttcgtgttcagcagcgtggtgatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcttcctgatctacctgggcagaaccggcctgagcaagatgtggctggccgccaccaagaaggccagctga

SEQ ID NO: 9661 - RNA, 3204 nt, synthetic construct
  misc_feature 1..3204: note = derived and/or modified CDS sequence (opt4) from RVFV(Beijing-01)__KX611606.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcgtgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggcagactgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtgttcgactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgttcgagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9662 - RNA, 3204 nt, synthetic construct
  misc_feature 1..3204: note = derived and/or modified CDS sequence (opt4) from RVFV(KEN/Bar-032/07)__HM586968.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcgtgggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagccacaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9663 - RNA, 3204 nt, synthetic construct
  misc_feature 1..3204: note = derived and/or modified CDS sequence (opt4) from RVFV(TAN/Dod-002/07)__HM586971.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccaggcctggatcatcagccagtggcacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9664 - RNA, 3204 nt, synthetic construct
  misc_feature 1..3204: note = derived and/or modified CDS sequence (opt4) from RVFV(KEN/Gar-004/06)__HM586964.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagccagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagagaaccggcgacgccgccttctgcagcgcctacgagtgcaccgcccagtacgccaacgcctactgcagcagagccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaacaaccagagccacagcgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcctgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 9665 - RNA, 1680 nt, synthetic construct
  misc_feature 1..1680: note = derived and/or modified CDS sequence (opt4) from RVFV(ZH-548)__DQ380206.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9666 - RNA, 1680 nt, synthetic construct
  misc_feature 1..1680: note = derived and/or modified CDS sequence (opt4) from RVFV(MP-12)__DQ380208.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9667 - RNA, 1680 nt, synthetic construct
  misc_feature 1..1680: note = derived and/or modified CDS sequence (opt4) from RVFV(MP12)__Z30318.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccaccacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggcccacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9668 - RNA, 1680 nt, synthetic construct
  misc_feature 1..1680: note = derived and/or modified CDS sequence (opt4) from RVFV(2007001811)__EU574040.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9669 - RNA, 1680 nt, synthetic construct
  misc_feature 1..1680: note = derived and/or modified CDS sequence (opt4) from RVFV(2250/74)__DQ380209.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9670 - RNA, 1680 nt, synthetic construct
  misc_feature 1..1680: note = derived and/or modified CDS sequence (opt4) from RVFV(T1)__DQ380201.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9671 - RNA, 1680 nt, synthetic construct
  misc_feature 1..1680: note = derived and/or modified CDS sequence (opt4) from RVFV(Ken 199800523)__KU978777.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9672 - RNA, 1680 nt, synthetic construct
  misc_feature 1..1680: note = derived and/or modified CDS sequence (opt4) from RVFV(1853/78)__DQ380220.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9673 - RNA, 1680 nt, synthetic construct
  misc_feature 1..1680: note = derived and/or modified CDS sequence (opt4) from RVFV(73HB1449)__DQ380211.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9674 - RNA, 1680 nt, synthetic construct
  misc_feature 1..1680: note = derived and/or modified CDS sequence (opt4) from RVFV(2007000234)__JF326191.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9675 - RNA, 1680 nt, synthetic construct
  misc_feature 1..1680: note = derived and/or modified CDS sequence (opt4) from RVFV(73HB1230)__DQ380221.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagaaggagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9676 - RNA, 1680 nt, synthetic construct
  misc_feature 1..1680: note = derived and/or modified CDS sequence (opt4) from RVFV(ZM-657)__DQ380204.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaaggcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9677 - RNA, 1680 nt, synthetic construct
  misc_feature 1..1680: note = derived and/or modified CDS sequence (opt4) from RVFV(Kenya 83 (21445))__DQ380198.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9678 - RNA, 1680 nt, synthetic construct
  misc_feature 1..1680: note = derived and/or modified CDS sequence (opt4) from RVFV(SAUDI 200010901)__KU978778.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcatcagctacgccagcgcc

SEQ ID NO: 9679 - RNA, 1680 nt, synthetic construct
  misc_feature 1..1680: note = derived and/or modified CDS sequence (opt4) from RVFV(2007004194)__EU574031.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgagcaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9680 - RNA, 1680 nt, synthetic construct
  misc_feature 1..1680: note = derived and/or modified CDS sequence (opt4) from RVFV(ZH-501-777)__DQ380202.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggaccccggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9681 - RNA, 1680 nt, synthetic construct
  misc_feature 1..1680: note = derived and/or modified CDS sequence (opt4) from RVFV(ZC-3349)__DQ380207.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccaggccgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccacgtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9682 - RNA, 1680 nt, synthetic construct
  misc_feature 1..1680: note = derived and/or modified CDS sequence (opt4) from RVFV(200803166)__JF311381.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctgaagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccaccgcc

SEQ ID NO: 9683 - RNA, 1680 nt, synthetic construct
  misc_feature 1..1680: note = derived and/or modified CDS sequence (opt4) from RVFV(1260/78)__DQ380214.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgcacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9684 - RNA, 1680 nt, synthetic construct
  misc_feature 1..1680: note = derived and/or modified CDS sequence (opt4) from RVFV(T-46 (228113))__DQ380199.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccaaggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9685 - RNA, 1680 nt, synthetic construct
  misc_feature 1..1680: note = derived and/or modified CDS sequence (opt4) from RVFV(ZINGA J83 R1)__KU978776.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagactgatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcc

SEQ ID NO: 9686 - RNA, 1680 nt, synthetic construct
  misc_feature 1..1680: note = derived and/or modified CDS sequence (opt4) from RVFV(clone 13)__DQ380213.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagaaccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9687 - RNA, 1680 nt, synthetic construct
  misc_feature 1..1680: note = derived and/or modified CDS sequence (opt4) from RVFV(SA01-1322)__KX096942.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgccttctgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcgaccccgcccccatccccagacacgcccccatccccagatacagcacctacctgatgctgctgctgatcatcagctacgccagcgcc

SEQ ID NO: 9688 - RNA, 1680 nt, synthetic construct
  misc_feature 1..1680: note = derived and/or modified CDS sequence (opt4) from RVFV(25010-24)__KM210509.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctgatcgtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9689 - RNA, 1680 nt, synthetic construct
  misc_feature 1..1680: note = derived and/or modified CDS sequence (opt4) from RVFV(200803162)__JF311377.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcgccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgagaaaccccgcccccatccccagacacgcccccatccccagatacagcacctacctgatgctgctgctgatcgtgagctacgccagcgcc

SEQ ID NO: 9690 - RNA, 1680 nt, synthetic construct
  misc_feature 1..1680: note = derived and/or modified CDS sequence (opt4) from RVFV(2007002476)__EU574036.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcaagtgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9691 - RNA, 1680 nt, synthetic construct
  misc_feature 1..1680: note = derived and/or modified CDS sequence (opt4) from RVFV(Hv-B375)__DQ380218.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagaacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9692 - RNA, 1680 nt, synthetic construct
  misc_feature 1..1680: note = derived and/or modified CDS sequence (opt4) from RVFV(OS-1)__DQ380186.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9693 - RNA, 1680 nt, synthetic construct
  misc_feature 1..1680: note = derived and/or modified CDS sequence (opt4) from RVFV(2373/74)__DQ380194.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatggtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9694 - RNA, 1680 nt, synthetic construct
  misc_feature 1..1680: note = derived and/or modified CDS sequence (opt4) from RVFV(Kenya 57 (Rintoul))__DQ380192.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9695 - RNA, 1680 nt, synthetic construct
  misc_feature 1..1680: note = derived and/or modified CDS sequence (opt4) from RVFV(Sudan 2V-2007)__JQ820490.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcagcgtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagccacgccagcgcc

SEQ ID NO: 9696 - RNA, 1680 nt, synthetic construct
  misc_feature 1..1680: note = derived and/or modified CDS sequence (opt4) from RVFV(200803167)__JF311382.1__Gn
  source 1..1680: mol_type = other RNA
atggccggcatcgccatgaccgtgctgcccgccctggccgtgttcgccctggcccccgtggtgttcgccgaggacctgcacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcgccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9697 - RNA, 1680 nt, synthetic construct
  misc_feature 1..1680: note = derived and/or modified CDS sequence (opt4) from RVFV(KEN/Gar-008/06)__HM586965.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9698 - RNA, 1680 nt, synthetic construct
  misc_feature 1..1680: note = derived and/or modified CDS sequence (opt4) from RVFV(ANK-6087)__DQ380216.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaagctggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatgggtgtacagaaagatggtggccagagtggccgacaacatcaaccaggtgaacagagagatcggctggatggagggcggccagctggtgctgggcaaccccgcccccatccccagacacgtgcccatccccagatacagcacctacctgatgctgctgctgatcgtgagctacgccagcgcc

SEQ ID NO: 9699 - RNA, 1680 nt, synthetic construct
  misc_feature 1..1680: note = derived and/or modified CDS sequence (opt4) from RVFV(763/70)__DQ380188.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacggcctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9700 - RNA, 1680 nt, synthetic construct
  misc_feature 1..1680: note = derived and/or modified CDS sequence (opt4) from RVFV(BIME-01)__KX609032.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcc

SEQ ID NO: 9701 - RNA, 1680 nt, synthetic construct
  misc_feature 1..1680: note = derived and/or modified CDS sequence (opt4) from RVFV(KEN07-KUR340)__EF460404.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagaatgctgaagtgcctgaagatcgcccccagaatcgtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9702 - RNA, 1680 nt, synthetic construct
  misc_feature 1..1680: note = derived and/or modified CDS sequence (opt4) from RVFV(SA-51 (Van Wyck))__DQ380195.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggcagaggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9703 - RNA, 1680 nt, synthetic construct
  misc_feature 1..1680: note = derived and/or modified CDS sequence (opt4) from RVFV(Lunyo)__KU167026.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggtgagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9704 - RNA, 1680 nt, synthetic construct
  misc_feature 1..1680: note = derived and/or modified CDS sequence (opt4) from RVFV(2269/74)__DQ380222.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagcacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9705 - RNA, 1680 nt, synthetic construct
  misc_feature 1..1680: note = derived and/or modified CDS sequence (opt4) from RVFV(MgH824)__DQ380210.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggctacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagagaaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccacccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9706 - RNA, 1680 nt, synthetic construct
  misc_feature 1..1680: note = derived and/or modified CDS sequence (opt4) from RVFV__JQ068143.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatcgacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcc

SEQ ID NO: 9707 - RNA, 1680 nt, synthetic construct
  misc_feature 1..1680: note = derived and/or modified CDS sequence (opt4) from RVFV(RVFBJ01/2016)__KX785331.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagcacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcc

SEQ ID NO: 9708 - RNA, 1680 nt, synthetic construct
  misc_feature 1..1680: note = derived and/or modified CDS sequence (opt4) from RVFV(KEN/Kil-006/07)__HM586966.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9709 - RNA, 1680 nt, synthetic construct
  misc_feature 1..1680: note = derived and/or modified CDS sequence (opt4) from RVFV(SA-75)__DQ380189.1__Gn
  source 1..1680: mol_type = other RNA
atggccagaatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9710 - RNA, 1680 nt, synthetic construct
  misc_feature 1..1680: note = derived and/or modified CDS sequence (opt4) from RVFV(35/74)__JF784387.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcgtggtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctggaccccctgatgtggatcaccgtgttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9711 - RNA, 1680 nt, synthetic construct
  misc_feature 1..1680: note = derived and/or modified CDS sequence (opt4) from RVFV__M11157.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacggcctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggcccacaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcatcgccatcatctgcctggccgtgctgtacagagtgctgaagtgcctgaagatcgcccccagaaaggtgctgaaccccctgatgtggatcaccgccttcatcagatggatctacaagaagatggtggccagagtggcccacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9712 - RNA, 1680 nt, synthetic construct
  misc_feature 1..1680: note = derived and/or modified CDS sequence (opt4) from RVFV(KEN/Bar-035/07)__HM586969.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9713 - RNA, 1680 nt, synthetic construct
  misc_feature 1..1680: note = derived and/or modified CDS sequence (opt4) from RVFV(Kenya 56 (IB8))__DQ380190.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccagggcgacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaaggactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagagacccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatgagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagcccgccctgggcaaccccgcccccatccccagacacgcccccatccccagatacagcacctacctgatgctgctgctgatcgtgagctacgccagcgcc

SEQ ID NO: 9714 - RNA, 1680 nt, synthetic construct
  misc_feature 1..1680: note = derived and/or modified CDS sequence (opt4) from RVFV(KEN/Bar-032/07)__HM586968.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcagactgcaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgccgacggcaacaagtgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcgtgggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9715 - RNA, 1680 nt, synthetic construct
  misc_feature 1..1680: note = derived and/or modified CDS sequence (opt4) from RVFV(Beijing-01)__KX611606.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcgtgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggcagactgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtgttcgactgccccccccaggacccctgcctggtgcacggctgcatcgtgtgcgcccacggcctgatcaactaccagtgccacaccgccctgagcgccttcgtggtggtgttcgtgttcagcagcgtggccatcatctgcctggccatcctgtacaaggtgctgagatgcctgaagatcgcccccaagaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcatcagctacgccagcgcc

SEQ ID NO: 9716 - RNA, 1680 nt, synthetic construct
  misc_feature 1..1680: note = derived and/or modified CDS sequence (opt4) from RVFV(Smithburn)__DQ380193.1__Gn
  source 1..1680: mol_type = other RNA
atggccggcatcgccatgaccgtgttccccgccctggtggtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacatcatcatcgccaaggccgacccccccagctgcaacctgcagagcgcccacggcaacccctgcatgaaggagaagctggtgatgaagacctactgccccaacgactaccagagcgcccactacctgaacaacgacggcaagatggccagcgtgaagtgcccccccaagcacgagctgaccgaggactgcaacttctgcagacagatgaccggcgccagcctgaaggagggcagctaccccctgcaggacctgttctgccagagcagcgaggacgacggcagcaagctgaagaccaagatgaagggcgtgtgcgaggtgggcgtgcaggtgctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagatcaagagagagctgaagagcttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaactaccagtgccacaccgccttcagcgccttcgtggtggtgttcgtgttcagcagcgtggtgatcatctgcctggccatcctgtacaaggtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcc

SEQ ID NO: 9717 - RNA, 1680 nt, synthetic construct
  misc_feature 1..1680: note = derived and/or modified CDS sequence (opt4) from RVFV(TAN/Dod-002/07)__HM586971.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccaggcctggatcatcagccagtggcacaccgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9718 - RNA, 1680 nt, synthetic construct
  misc_feature 1..1680: note = derived and/or modified CDS sequence (opt4) from RVFV(KEN/Gar-004/06)__HM586964.1__Gn
  source 1..1680: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgcaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgcagagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagccagaaggtgtacctggacaagctggacctgaagaccgaggagaacctgctgcccgacagcttcgtgtgcttcgagcacaagggccagtacaagggcaccatggacagcggccagaccaagagagagctgaagagcttcgacatcagccagtgccccaagatcggcggccacggcagaaagaagagaaccggcgacgccgccttctgcagcgcctacgagtgcaccgcccagtacgccaacgcctactgcagcagagccaacggcagcggcatcgtgcagatccaggtgagcagagtgtggaagaagcccctgtgcgtgggctacgagagagtggtggtgaagagagagctgagcgccaagcccatccagagagtggagccctgcaccacctgcatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacggctgcatcgtgtgcgcccacggcctgatcaacaaccagagccacagcgccctgagcgccttcgtggtgatcttcgtgttcagcagcaccgccatcatctgcctggccgtgctgtacagagtgctgaagtgcctgaagatcgcccccagaaaggtgctgaaccccctgatgtggatcaccgccttcatcagatgggtgtacaagaagatggtggccagagtggccgacaacatcaaccaggtgaacagagagatcggctggatggagggcggccagctggccctgggcaaccccgcccccatccccagacacgcccccatccccagatacagcacctacctgatgctgctgctgatcgtgagctacgccagcgcc

SEQ ID NO: 9719 - RNA, 1521 nt, synthetic construct
  misc_feature 1..1521: note = derived and/or modified CDS sequence (opt4) from RVFV(ZH-548)__DQ380206.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9720 - RNA, 1521 nt, synthetic construct
  misc_feature 1..1521: note = derived and/or modified CDS sequence (opt4) from RVFV(35/74)__JF784387.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9721 - RNA, 1521 nt, synthetic construct
  misc_feature 1..1521: note = derived and/or modified CDS sequence (opt4) from RVFV(200803162)__JF311377.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9722 - RNA, 1521 nt, synthetic construct
  misc_feature 1..1521: note = derived and/or modified CDS sequence (opt4) from RVFV(200803166)__JF311381.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacgtggtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9723 - RNA, 1521 nt, synthetic construct
  misc_feature 1..1521: note = derived and/or modified CDS sequence (opt4) from RVFV(SA-51 (Van Wyck))__DQ380195.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggaggtgaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9724 - RNA, 1521 nt, synthetic construct
  misc_feature 1..1521: note = derived and/or modified CDS sequence (opt4) from RVFV(ZINGA J83 R1)__KU978776.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9725 - RNA, 1521 nt, synthetic construct
  misc_feature 1..1521: note = derived and/or modified CDS sequence (opt4) from RVFV(Entebbe)__DQ380191.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9726 - RNA, 1521 nt, synthetic construct
  misc_feature 1..1521: note = derived and/or modified CDS sequence (opt4) from RVFV(Sudan 2V-2007)__JQ820490.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatggccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9727 - RNA, 1521 nt, synthetic construct
  misc_feature 1..1521: note = derived and/or modified CDS sequence (opt4) from RVFV(Sudan 86-2010)__JQ820489.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtgatcttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9728 - RNA, 1521 nt, synthetic construct
  misc_feature 1..1521: note = derived and/or modified CDS sequence (opt4) from RVFV(Kenya 56 (IB8))__DQ380190.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggccttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9729 - RNA, 1521 nt, synthetic construct
  misc_feature 1..1521: note = derived and/or modified CDS sequence (opt4) from RVFV(ARD-38388)__DQ380187.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcatcggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcatcctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9730 - RNA, 1521 nt, synthetic construct
  misc_feature 1..1521: note = derived and/or modified CDS sequence (opt4) from RVFV(Sudan 28-2010)__JQ820491.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggtgctgagcatcggcctgttcttcctgctgatctacctgggcagaaccggcctgagcaagatgtggctggccgccaccaagaaggccagc

SEQ ID NO: 9731 - RNA, 1521 nt, synthetic construct
  misc_feature 1..1521: note = derived and/or modified CDS sequence (opt4) from RVFV(200803167)__JF311382.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatgctgctgatctgcctgtacgtggccctgagcatcggcctgttcttcctgctgatctacctgggcagaaccggcctgagcaagatgtggctggccgccaccaagaaggccagc

SEQ ID NO: 9732 - RNA, 1521 nt, synthetic construct
  misc_feature 1..1521: note = derived and/or modified CDS sequence (opt4) from RVFV(73HB1230)__DQ380221.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccatcatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9733 - RNA, 1521 nt, synthetic construct
  misc_feature 1..1521: note = derived and/or modified CDS sequence (opt4) from RVFV(2250/74)__DQ380209.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccaaggtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9734 - RNA, 1521 nt, synthetic construct
  misc_feature 1..1521: note = derived and/or modified CDS sequence (opt4) from RVFV(SAUDI 200010901)__KU978778.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9735 - RNA, 1521 nt, synthetic construct
  misc_feature 1..1521: note = derived and/or modified CDS sequence (opt4) from RVFV(Lunyo)__KU167026.1__Gc
  source 1..1521: mol_type = other RNA
tgcagcgagctgatccaggccagcagcagaatcaccacctgcagcaccgagggcgtgaacaccagatgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9736 - RNA, 1521 nt, synthetic construct
  misc_feature 1..1521: note = derived and/or modified CDS sequence (opt4) from RVFV(25010-24)__KM210509.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9737 - RNA, 1521 nt, synthetic construct
  misc_feature 1..1521: note = derived and/or modified CDS sequence (opt4) from RVFV(2007000253)__JF326192.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgccggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9738 - RNA, 1521 nt, synthetic construct
  misc_feature 1..1521: note = derived and/or modified CDS sequence (opt4) from RVFV(ZC-3349)__DQ380207.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgaaggcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9739 - RNA, 1521 nt, synthetic construct
  misc_feature 1..1521: note = derived and/or modified CDS sequence (opt4) from RVFV(OS-1)__DQ380186.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgaaggtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9740 - RNA, 1521 nt, synthetic construct
  misc_feature 1..1521: note = derived and/or modified CDS sequence (opt4) from RVFV(KEN/Gar-004/06)__HM586964.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9741 - RNA, 1521 nt, synthetic construct
  misc_feature 1..1521: note = derived and/or modified CDS sequence (opt4) from RVFV(Smithburn)__DQ380193.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcttcctgatctacctgggcagaaccggcctgagcaagatgtggctggccgccaccaagaaggccagc

SEQ ID NO: 9742 - RNA, 1521 nt, synthetic construct
  misc_feature 1..1521: note = derived and/or modified CDS sequence (opt4) from RVFV(2008/00101)__HE687306.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccaccctgctgatctgcctgtacgtggccctgagcatcggcctgttcttcctgctgatctacctgggcagaaccggcctgagcaagatgtggctggccgccaccaagaaggccagc

SEQ ID NO: 9743 - RNA, 1521 nt, synthetic construct
  misc_feature 1..1521: note = derived and/or modified CDS sequence (opt4) from RVFV(2007001292)__EU574046.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacctgttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9744 - RNA, 1521 nt, synthetic construct
  misc_feature 1..1521: note = derived and/or modified CDS sequence (opt4) from RVFV(2007002445)__EU574037.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcatccaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9745 - RNA, 1521 nt, synthetic construct
  misc_feature 1..1521: note = derived and/or modified CDS sequence (opt4) from RVFV(Ken 199800523)__KU978777.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgaacgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggagggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9746 - RNA, 1521 nt, synthetic construct
  misc_feature 1..1521: note = derived and/or modified CDS sequence (opt4) from RVFV(clone 13)__DQ380213.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggacgaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9747 - RNA, 1521 nt, synthetic construct
  misc_feature 1..1521: note = derived and/or modified CDS sequence (opt4) from RVFV(2373/74)__DQ380194.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccctggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9748 - RNA, 1521 nt, synthetic construct
  misc_feature 1..1521: note = derived and/or modified CDS sequence (opt4) from RVFV(OS-8)__DQ380185.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgagaatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgagcggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9749 - RNA, 1521 nt, synthetic construct
  misc_feature 1..1521: note = derived and/or modified CDS sequence (opt4) from RVFV(KEN/Bar-035/07)__HM586969.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccagaagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9750 - RNA, 1521 nt, synthetic construct
  misc_feature 1..1521: note = derived and/or modified CDS sequence (opt4) from RVFV(MgH824)__DQ380210.1__Gc
  source 1..1521: mol_type = other RNA
tgcagcgagctgatccaggccagcagcagaatcaccacctgcagcaccgagggcgtggacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttccccgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9751 - RNA, 1521 nt, synthetic construct
  misc_feature 1..1521: note = derived and/or modified CDS sequence (opt4) from RVFV(200803169)__JF311384.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggtggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgaggtgagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9752 - RNA, 1521 nt, synthetic construct
  misc_feature 1..1521: note = derived and/or modified CDS sequence (opt4) from RVFV(2007001811)__EU574040.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgatgatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgagaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9753 - RNA, 1521 nt, synthetic construct
  misc_feature 1..1521: note = derived and/or modified CDS sequence (opt4) from RVFV(Kenya 57 (Rintoul))__DQ380192.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccgtggacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatcagcagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9754 - RNA, 1521 nt, synthetic construct
  misc_feature 1..1521: note = derived and/or modified CDS sequence (opt4) from RVFV(Beijing-01)__KX611606.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgttcgagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9755 - RNA, 1521 nt, synthetic construct
  misc_feature 1..1521: note = derived and/or modified CDS sequence (opt4) from RVFV(ANK-6087)__DQ380216.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcagcaccaacctgatcgaccccttcgtggtgttcaagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgagaggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9756 - RNA, 1521 nt, synthetic construct
  misc_feature 1..1521: note = derived and/or modified CDS sequence (opt4) from RVFV(MP12)__Z30318.1__Gc
  source 1..1521: mol_type = other RNA
tgcagcgagctgatccaggccagcagcagaatcaccacctgcagcaccgagggcgtgaacaccaagtgcagactgagcggcaccgccctgatcagagccggcagcgtgggcgccgaggcctgcctgatgctgaagggcgtgaaggaggaccagaccaagttcctgaagctgaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcggcaccggcctgagcaagatgtggctggccgccaccaagaaggccagc

SEQ ID NO: 9757 - RNA, 1521 nt, synthetic construct
  misc_feature 1..1521: note = derived and/or modified CDS sequence (opt4) from RVFV(KEN/Bar-032/07)__HM586968.1__Gc
  source 1..1521: mol_type = other RNA
tgcagcgagctgatccaggccagcagcagaatcaccacctgcagcaccgagggcgtgaacaccaagtgcagactgagccacaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctggtgagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgagattcgacaacttcgaggtggacttcgtgggcgccgccgtgagctgcgacgccgccttcctgaacctgaccggctgctacagctgcaacgccggcgccagagtgtgcctgagcatcaccagcaccggcaccggcaccctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagc

SEQ ID NO: 9758 - RNA, 4020 nt, synthetic construct
  misc_feature 1..4020: note = derived and/or modified CDS sequence (opt4) from SFNV(Toscana)__NC_006320.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcaacgtggccaagcccgccaacaagatcgcccccatcagcgtgatccccccccccatcgtgaagcccatccccatcgccgagagcaccatcaagaagaccatccccttcgacaagctgctgagcgaggccgagaaggagctgaaccagaccaagatcagactggagaccgagagaagaagcaacgccgaggaggccgccagagagagagccagaatgagagagatcgaggacaagctgagaaagaactgggagctggagagagagagaaaggacgccgtggccgacgacctggccaaggagatcgccagaagaagagagatcgagagaaaggcccacgagctggacaagatgctgaagaagaaggagagagaggaccaggtggccatcgagagagtgagcgaggacatgagaaaccacgtgagaagacccaacaccaccatcgcccccgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcaagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcaacaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagagaggctggaccgagagcatccccagcaccagatacagcaaggacctgtgcagcatcggcctgcacaccgtgaaggagtgcaagaccggcaccaccaacttcgagagagtgggcttcatcgtggtgaagagcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaagatggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgcggctggatgatcaagagctggaagaagaaggtgggcagcgccatcagcagaaccaacgacaccatcggctggagagacaacagaagatacggcagagacgtggagagagcccagtacaccggcggcgcccccggcgccaagtacagcttctacggcgtgatgatcctgggcctgctgggcaacgtgcacagctgcagcgagagcgtgatcgccgacagcaaggtgatgcagtgcaccaccagcggcagcagcaccctgtgcaaggccagcggcaccgtgatcatgaagctgggccccatcggcagcgagagctgcctgatcctgaagggcctgaaggacaacgagaagcagttcatcagcatcaagaccatcagcagcgagctgacctgcagagagggcgagagcttctggaccaccctgtacacccccgtgtgcctgagcagcagaagatgccacctgatgggcgagtgctgcagcgacagatgcctgaagtggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagcatcctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcctggccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccacaacagccagagcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagccccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcaccatcgccagaaccggcgtggagcaggccctgaagaagaagaacaagtga

SEQ ID NO: 9759 - RNA, 3972 nt, synthetic construct
  misc_feature 1..3972: note = derived and/or modified CDS sequence (opt4) from SFNV__HM566171.1__GP
  source 1..3972: mol_type = other RNA
atgctgaacaccaagagcatcatcctgatcacctgcctggtgcagcaggtgcacctgaagtacaccatcatcagcgaggtgaccaagggcgccagagaggtgagctgctacagcagcaccaccagactggaccagctgctggaggcctgggagaacaagagcgccctgatgggcctgagaaagggcaactgcaagctgggcgccatggagcaggtggactgcaacctggacctgatgagcaactacgtgagcaacgtgtacgacaacccccacggcctgggcgccatgatgtacaacgacaagagaatcgaggtgctgaacgaccagatccccgacagcatgatccccggcggccacaactgcagcctgctggagagaaagcccttctgggccgacctgatccccagcaagaaggagaaccccagacccagcctgatcagcctggtgcccacccccagaagcgacttcaagagaaagttcgaggaggccgaggaggagatgaagaagatcagaaaggagctgcaggacgagagacaggcccagctgagcgtgatcgaggagggcagaaagagaatgagagacctggaggacaagctgatgagacagtggaacgaggagaagcagaagaagggcctgctggaggagaccctggagaagaagagacagctgaagaacaaggccctgctggacgcccacaacctggacaagcagctgaaggagaaggacagagagttcaagaccgccatggaggagcaccagaacgagagacacagaatcaacagcaacatgatcagaccccccatcaccacccccgccgccgtgatcctgaccagcctgctgagcgccagcgtggtgctgggcttcgagctggagaacagaaacaccaaccacgccctgaacagacccggcaacggcggctacagcatcagcgacaacaacctgatcgaggccaagtgcatgatcacctacggcaacaagtgccccagctgggagatgcagctggaccccgtgagctaccccttcttcagcagcaacttcgagaagtacagcctgctggagagcatcagcgagaccagccccatcatcggcaagttcagcgaggtgtgcgtgctgagcaacctgcccggcgcccagaagacctgcgccaaggaggccagcctgatcaagaagcagtgcagcgacgacatgagagcctacttctacatcaacagcctgggcaagctggccatcgtgacctgccccgagaacaacgtgctgagccaggactgcaacttctgcctgagaaaggccaagggcgagcagtacgtgtacaagcccatccaggacggcttctgccagaacggcggcgtgagcagcgtgcccagcatcagatacagcaaggacatctgcagcatcggccccaccaaggtgaagaactgccacaagggcaccagcagatacgagagaaccgccttcatcagcaccggcgacaagaaggtgtacctggaggagatcaagatcagaagcagacaggagtacgagcccgaccagttcctgtgctacaaggtgaaggacagcagcagcagccccctggcctacgagaaggtgcaggtgagcaagtgcaagggcatcgagaccaacagccccaagaagtgcaccggcgacgagtacttctgcagcaagtacccctgcgagagcaccagccccgaggccaactgcttcctgagaaagcacagcgccatcctggaggtgaacatcggcggcatgtggatcaagcccaagtgcatcggctacgagatggccctggtgaagagagtgggcctgagaagcgaggacgtgagcagcaaggagtgcgccacctgcctgtgggagtgcagcagcggctacatcagcatcaccacccacggccccaagatcagctacgccaccgcctgcagccacggcagctgcaagagcatcgtgcagaaccccagcaccagcatcagaatcagctaccccggcaacagcgagatcgtgggcggcgacatcggcatccacctgaccgaggacagcagccccatcaacctgcacctgaagatccactgcagccccaaggacagctgcgaggtgagcgactgcatcttctgcgtgcacggcctgctgaactaccagtgccacagcgtggccagcgccctgctgctgagcaccatcaccgccagcctgatcgtgctgatgatctacatgctgagcaagaccaagttcgtgatgaagaagctgatccccatcatgctgacccccctgtgctggtgcttcgtgctgctggcctggctgaccaagagctggaagggcaagatgagaaacgccatccagagcgccaacagcaccatcggctggaccgagagagaggagagaatcgtggccgagagacccagaagcagaaacaccgtgagatacagcttctacggcgtggtgatcctggccatgctggagagcgccttcggctgcagcgagagcctgatcgccgagagcaaggtgatgcagtgcaacatcgccaacggcaagaccagctgcagagccagcggcaccatcatcatgaagctgggccccatcggcagcgaggcctgcctgatcctgaagggcctgagagacagcgacaagcagtacatcagcgtgaagaccgagagcagcgagctgatctgcagagagggcgagagcttctggaccagcctgtacacccccgtgtgcctgagcagcagaagatgccacctgatgggcgagtgcaccggcgacctgtgcctgaagtggaagagcaacaagaccagcctggagttcgccggcaagaccagaagcgacgtgatcaacgagaacaagtgcttcgagcagagcggcggcctgggctacggctgcttcaacgtgaaccccagctgcctgtacacccacgcctacctgaagagcgtgtacagaaacggcttcagagtgttcaagtgcgccagctggacccacagagtgaagctgaccatcaccacccacagcagaaccttccccatgaccctggccgccatgagcacccagcccaccgactggggcagcatcggcctgatcctggacagcgagggcatcagcggcaccaacagcttcagcttcatgaagcacggcctgggcagcttcgccatcatcgacgagccctacagcatggagcccagaaagggcttcatcggcgaggtgagatgccccaccgaggaggccgccatcaaggccagcaccctgtgcaagaccgccccccagctgatcgagtaccagcccgagatggacagcgccgagtgcaccaccaacatgatcgaccccatgagcgtgttcaacagaggcagcctgccccaggtgagagagggcatgaccttcacccagagcatggagaagaacaccgtgcaggccatgaccaccggcgaggtgcacgccagcatcagaatcgtgctggacgactacgaggtggagtacctgagcagccaggtggactgcgacgccaccttcaagaacctgaccggctgctacagctgcgacgagggcgccagagtgtgcatgcagatcatcgcccacggcgacaccatcttccacttcagaaaccccgacgtgagcatcaacatcctgcagaaggtgaacaccaacaccctgatctactgcagcgtggtgcacttcagcaagcccgtgatcaaggaggagggcacctacgactgcggcgccggcgagaagcccatgatcctgaagggcaccctggtggccgtgagcccccacaacgacagactggagcagggcggcagcagcatcgtgatcaaccccaagggcggcggcgtggacttcctgggctggctgagcggcttcagcagctggttcggcggccccctgaaggccatcctgatggtgatcggcttcctgctgctgggcctgatcctgttcgtgaccatcgccatcggcctgaagttcgccctgagacagatgatcgtgaagagaatgaagtga

SEQ ID NO: 9760 - RNA, 3873 nt, synthetic construct; identical to SEQ ID NO: 9443
  misc_feature 1..3873: note = derived and/or modified CDS sequence (opt4) from SFNV(Namru)__HM566169.1__GP
  source 1..3873: mol_type = other RNA

SEQ ID NO: 9761 - RNA, 3990 nt, synthetic construct
  misc_feature 1..3990: note = derived and/or modified CDS sequence (opt4) from SFNV/SFNV-like(Poona)__HM566177.1__GP
  source 1..3990: mol_type = other RNA
atgctgaacgtgaagagcgtgatcctgatcacctgcctggtgcagcaggcccacctgaagtacaccatcatcagcgaggtggccaagggcgccagagaggtgagctgctacagcagcaccaccagactggaccagctgctggaggcctgggagaacaagagcgccctgatcggcctgaagagaggcaactgcaagctgggcgccatggagcagatcaactgcaacctggacctgatgagcaactacgtgagcaacgtgtacgacaacccccacggcctgggcgccatgatgtacaacaccgacagcgacaagagaatcgaggtgctgaacgaccagatccccgacagcatgatccccggcggccacaactgcagcctgctggagagaaagcccttctgggccgacctgatcccccccaagaaggagaaggagctggaccccaagcccagcctgatcagcctggtgcccacccccagagacgacttcaagaagaagttcgaggaggccgaggaggagatgaagaagatcagaaaggagctgcagaacgagagacaggcccagctgagcgtgatggaggacagcagaaagaagatgagagacctggaggacagactgatgagacagtgggaggaggagaagcagaagaagggcctgctggaggagaccctggagaaggagagacagctgaagaacaaggccctgctggacgcccacgacctggacaagcagctgaaggagagagacagagagttcaagaccgccatggaggagcaccagaacgagagaagaagaatcaacagcaacatgatcagaccctacgtgaccacccccgccgccatcatcctgaccagcctgctgagcgccagcgtggtggtgggcttcgagctggagaacagaaacaccaaccacgtgctgaacagacccggcaacggcggctacagcatcagcgacaacaacctgatcgaggccaagtgcatgatcacctacggcaccaagtgcctgagctgggagatgcagctgaaccccgtgagctaccccttcttcagcagcaacttcgagaagtacagcctgctggagagcgtgagcgagaccacccccatcatcggcaagttcagcgaggtgtgcgtgctgagcaacctgagcggcgcccagaagacctgcgccaaggaggccagcctgatcaagaagcagtgccccgacgacatcagagcctacttctacatcaacagcctgggcaagctggccatcgtgacctgccccgagaacaacgtgctgagccaggactgcaacttctgcgtgcccaaggccaagggcgagagatacatctacaagcccatccaggacggcttctgccagaacggcggcgtgagcaccgtgcccagcgtgagatacagcaaggacatctgcagcatcggccccctgaaggtgaagaactgccacaagggcaccagcagatacgagagaaccgccttcatcagcaccggcgacaagaaggtgtacctggaggaggtgaagatcagaagcagacaggagtacgagcccgaccagttcctgtgctacaaggtgaaggacggcagcagcagccccctggtgtacgagaaggtgcaggtgagcaagtgcaagggcatcgagaccaacagccccaagaagtgcaccggcgacgagtacttctgcagcaagtacccctgcgagagcaccagccccgaggccaactgctacctgagaaagcacagcgccatcatcgaggtgaacatcggcggcatgtgggtgaagcccaagtgcgtgggctacgagatggccctggtgaagagagtgggcctgagaagcgaggacgtgagcctgaaggagtgcgccacctgcctgtgggagtgcagcagcagctacatcagcatcaccacccacggccccaagatcagctacgccaccgcctgcagccacggcagctgcaagagcgtggtgcagagccccagcaccagcatcaagatcagctaccccggcaacagcgagatcgtgggcggcgacatcggcatccacctgaccgaggacagcagccccgtgaacctgcacctgaagatccactgcccccccaaggacagctgcgaggtgagcgactgcatcctgtgcgtgcacggcctgctgaactaccagtgccacagcgtggccagcgccctgctgctgagcaccatcatcgccagcctgatcgccctggtggtgtacatgctgagcaagaccagattcgtgatgagaaagatcgtgcccatcatgttcatccccttctgctggtgcttcgtgctgctggcctggctgaccagaagctggaagggcaaggtgagaaacgccatccagagcgccaacaacaccatcggctggaccgagagagaggagagagtgatcgccgagagacccggcggcagaaacaccatcagatacagcttctacggcgtggtgatcctggccatcctggagagcgccttcggctgcagcgagagcctgatcgccgagagcaagatcatgcagtgcaacatcgccaacggcaagaccagctgcagagccagcggcaccatcatcatgaagctgggccccatcggcagcgaggcctgcctgatcctgaagggcctgagagacagcgacaagcagtacatcagcgtgaagaccgagagcagcgagctgatctgcagagagggcgagagcttctggaccagcctgtacacccccgtgtgcctgagcagcagaagatgccacctgatgggcgagtgcaccggcgacctgtgcctgaagtggaagagcaacaagaccagcctggagttcgccggcaagacccacagcgaggtgatgaacgagaacagatgcttcgagcagagcggcggcctgggctacggctgcttcaacatcaaccccagctgcctgtacacccacgcctacctgaagagcgtgtacagaaacggcttcagagtgttcaagtgcgccagctggacccacagagtgagactgaccatcaccacccacagcagaaccttccccatgaccctggccgccatgagcacccagcccaccgactggggcagcatcggcctgatcctggacagcgagggcatcagcggcaccaacagcttcagcttcatgaagcacggcctgggcagcttcgccatcatcgacgagccctacagcatggagcccagaaagggcttcatcggcgaggtgagatgccccaccgaggaggccgccatcaaggccagcaccctgtgcaagaccgccccccagctgatcgagtaccagcccgagatggacagcgtggagtgcaccaccaacatgatcgaccccatgagcatcttcaacagaggcagcctgccccaggtgagagagggcatgaccttcacccagagcatggagaagaacaccgtgcaggccatgaccaccggcgaggtgcacgccagcatcagactggtgctggacgactacgaggtggagtacctgagcaaccaggtggactgcgacgccaccttcaagaacctgaccggctgctacagctgcgacgagggcgccagagtgtgcatgcagatcaaggcccacggcgacaccatcttccacttcaagaacagcgacatgagcatgaacatcctgcagaaggtgagcaccaacaccctgatctactgcagcgtggtgcacttcagcaagcccgtgatcaaggaggagggcgtgtacgactgcggcgccggcgagaagcccatgatcctgaagggcaccctggtggccgtgagcccccacaacgacagactggagcagggcggcagcagcatcgtgatcaaccccaagggcagcggcgtggacttcctgggctggctgagcggcttcagcagctggttcggcggccccctgaaggccatcctgaccgtgatcggcttcctgctgctgggcttcctgctgttcatgctggtgaccatcggcctgagatacgccctgagccaggtggtgaccaagaagatgaagtga

SEQ ID NO: 9762 - RNA, 4002 nt, synthetic construct
  misc_feature 1..4002: note = derived and/or modified CDS sequence (opt4) from Arrabida virus(PoSFPhlebV/126/2008)__KP863800.1__GP
  source 1..4002: mol_type = other RNA
atgttctacgccaagttcatcctgctgctgtgcttcgtgcagggcgccctgctgaagtacaccatcatcagcaaggtgggcagcagcacctacaagagagtgtgcctgagccacaccaccgacctggacaccctgctggacatgaccagcagagagatgagcaacatcaagctgaccggcggcagctgcagcctgggcgacctgaccaagcccgactgcagccccgacttcttcagcaactacgtggccaacatccagagcagcaacaccaagatcaccggcaagttccaggacatcatcggcgagagagagatggaggtgaccaacgacgtggtgcccgacagcttcggccccggcccccacgactgcgtgagcttcgacaagaagcccttctggagcgacctgctgcccaccagcgtgagcaaggaggagcccaagcccatcatcagcaccctgagcgtgctgcccgccgccccccccatcaaggacttcagccacaaggtggtggaggccgaggagatggtgaaggagatcgagggcgagctgatgaaggagaaggagagaaacagcgccaaggaggaggaggccagacagagaatgagagagctggaggacgacctgagaaagcagtgggccgccgagagaatggccaagcagaacatgagcagcgtgctggagagagagagacaggagaagcagagcctggagagaagaatgcacgaggtggacaagaagctgagagccagcgaggacagagcccagaagtaccaggagagagccgagcaggccgagaagagccacagcaagctgctgagcagaagcggcgccgccaccaccatggccaccgtggtgttcaccagcctgctggccagcggcctggccgtggtgaccgagctggagaagagagacaccaaccacctgctgaacagacccggcaacggcgtgtacatggccaacgccgacagcctgatccagaccgagtgcaccctgaactacggccagagatgcctggcctgggagctgcagatcacccccgtgagataccccttcttcaccagcaacgtggacaagtacagcctgctggagagcatcaccgagacccccagcatcctggagaagaacaacgagagctgccagctggccaccaccagcggcagcctgaagacctgcgccaaggaggccagcaccatcaagaagcactgcaccgacgacgtgagagccttcttcttcatcaacagcgtgggcaagctgaccatcgtgagatgcgccgacaaccacatcctgagcgaggactgcaacttctgcatcagcaaggccagaaacagcaaccagaacatgttcatgcccgtgcaggacgccttctgccagagacagggcagcgacaccgcccccgccatcagatacagcaaggacatctgcagcatcggcgccatcaagatcaagcagtgccacaaggccaccagcaagttcgagagaatgggcttcatcagcgtgggccagaagaagctgtacatcgaggagctgaagctgagatacagacaggagtacgaccccgaccagttcatgtgctacaagatcaagagcagcagccccctgaagtacgagaaggtgagcagcaagaagtgcaaggaggtggacaccggcggcaaccagaagtgcagcggcgacgagcacttctgcaacagatacccctgcgacaccgccaaccccgaggcccactgcctgaccagaaagcacagcgccatcgccgaggtgaacatcggcggcgtgtggatcagacccaagtgcgtgggctacgagatggtgctggtgaagagaagcggcctgaagagcgaggacctgagcatcagagactgccccagctgcctgtgggagtgcaagaagagcagaatcaccatcaagacccacggccccaagatcgtgagcgccaccgcctgcagccacggcagctgcaagagcgtgatgcagaagcccagcaccttcgtggagatcccctaccccggcaacagcgagatcatcggcggcgacatcggcgtgcacatgaccgagagaggcagccccagcaacatccacgtgagaacccactgcccccccagagacagctgcgacgtgagcgactgcatgttctgcgtgcacggcatcctgaactaccagtgccacaccctggccagcgccctgaccatcgccaccatcgtgagcgccgtgctggtggtggtgtacttcctgctggccagaagcaagagagccgtgaagttcatcaccagcctgctgatcgtgcccttcaagtggctgaccctgctgagcatctgggtggtgaagaactggaagagaaagatgagcaagctggccagagccaccaacaacgccatcggctgggaccaggacgtggagagaggcagacccagagccgccgccggccaccagaaccaggtggccagatacaccttctacggcgccaccatcctgagcctgatgaccagcggcctgtgctgcaccgagagcgtgatcgccgagagcaacatcatgcagtgcaccaccagcgacagcaccaccacctgcaaggccagcggcaccatcatcctgagactgggccccatcggcagcgagagctgcctgatcctgaagggcctgagagacagcgagaagcagttcatcagcatcagaaccgtgagcagcgagctgacctgcagagagggcgacagcttctggaccagcctgtacacccccatctgcctgagcagcagaagatgccacctgatgggcgagtgcaccggcgacaactgcctgaagtggcaggacaacaagaccagcagcgagttcaccggcagaacccacagcgaggtgctgcacgagaacaagtgcttcgagcagagcggcggcatcggctacggctgcttcaacgtgaaccccagctgcctgatggtgcacagctacctgaagcccatctacaagaacgccttcaaggtgttcagatgcgtggcctggaaccacagagtgaagctggccatcaccacccacaagaagagcttcgacgtgaccctgatggccatgagcacccagcccaccgactggggcagcatcggcctgatcctggacagcgagggcatcaccggcaccaacagctacagcttcatgaagtacggcgtgggcagcttcgccatcatcgacgagcccttcagcatcgagcccagaaagggcttcctgggcgaggtgagatgccccaccgaggagaccgccgtgaaggccagccccagctgcaaggccgccccccagatcatcgagtaccaccccgagatggacaccgtggagtgcatcaccaacatgatggaccccatggccatcttcaacagaggcagcctgccccaggtgagagacggcgtgaccttcgcccagagcatcgagaagaacagcgtgcaggccctgaccaccggcgagatcaaggccagcgtgagactggtgctggacgactacgaggtggagtacaaggtgagcgagaacgactgcgacagcaccttcatcaacatcaccggctgctacagctgcgacgagggcgccagactgtgcgtgagaatcagaaccctgggcgacagcatctaccacttcaccgacagcgaggacatgatgaacgtgatgttcaaggtgaacagcagcgtgaccgagtactgcaccgtgctgcacttcagcaagcccgtggtgaacttcgagggcaagtacgactgcggcaagagcagaaagcccatgatcatcaagggcaccctgatcgccatggccccccacgacgacagagtgcacagcggcggcagcagcatcgtggtgaaccccaagagcaagggcgtggacttcctgggctggctgagcggcctgagcagctggctgggcggccccctgaagaccgtgctgaccgtgctgggcttcctgatcctgggcctggtgttcgtgatcgtggtgatcttcctggtgagagtgggcatcagacaggccctgctgaagaagatgaagtga

SEQ ID NO: 9763 - RNA, 4005 nt, synthetic construct
  misc_feature 1..4005: note = derived and/or modified CDS sequence (opt4) from Massilia virus(127)__KT906100.1__GP
  source 1..4005: mol_type = other RNA
atgttctacgccaagttcgtgatcagcctgtgcctggagcccggcttcagcctgaagtacaccatcatcagcaagagcggcagcggcaccatcagacagatctgcctgagccacagcaccgacatcgacaaggtgctggagctgagcagcggcgagatgaacaccatcggcatcctgggcggcctgtgcaccttcggcgagctgaagagagaggactgcagccccgacgtgttcagcaactacgtggccaacatgtacggcaccgcccaccccagcagctgcaagttcgtggacatcaccggcgacagaagcatcgaggtgctgaacgacgccgtgcccgacagcttcacccccggcgcccacaactgcagcagcttcgagaagaagcccttctggaccgacctgatccccgccaagaacagcagcggcgccatccccagcgtggtgagcgtgctgcccagcgtggccgagcacgacttcaacctgaaggtgaaggaggccaacgacaagctggaggtgatccagagagagctggccgccgagaaggccagaagcggcagactggaggacgaggccagagccaagatgaaggccctggaggacgagctgagaaacggctggctggccgagagagaggccaaggagctggccaagagcgccctggagaaggagagaatcaacaagctggaggtggagagaaagctgcacgacctgggcaagaagctgagacagagcgaggacgacgtggagaagatgagagtgcaccacaagaagggcagaaaggagagcgacgaggagatgaagatcgccagaaccaccgcccccagcgtgagcaccaccctggccaccgtggtgttcaccagcctgctggccaccggcctggccgccatcgagcccatcgaggacagaaacgtgaaccacatcctgaacagacccggcagcggcgtgtacatggccagccccaccctgacccagaacgagtgcagcctggactacggcaaggagtgcaaggcctgggagctgcaggtgagccccctgcactaccccttcttcaccagcaacgtggacaagtacaccttcctggagagcatcaccctgctgccccccatcctgctgatcaacaacgagttctgcgagctgaccaccagcagcggccccctgaagcagtgccagaaggagagcagcctgatcaagaagtgctgcaccgaggacgccagagcctacttcttcatcgacctggagggcaagctgagcatcgtgcactgcagcaacaaccaggtgctgagcgaggactgcaacttctgcgtgaccaagagcggcggcgtgagccacaagatcttcatgcccatccaggacgccttctgccagaagggcggcagcgagagcatccccgtggtgagatacagcaaggacatctgcagcatcggcctgagcaaggtgaagagctgccacaagagcaccagcagatacgagagaatgggcttcatcgtggccggcaagaagaagctgtacatcgaggacctgaagatgagatacagacaggagtacgacgaggaccagttcttctgctacaaggtgaacaagaccagccccctggagtacggcaaggagagccccagcaagtgcaagggcgtgggcagcaacgagcagaagtgcaacggcgacgagtacttctgcaacagatacccctgcgagaccaacagccccgaggcccactgcagcctgagaagacacgccgccgtggtggaggtgtacgtgggcggcgcctggatcaagcccaagtgcgtgggctacgagaaggtgctggtgaagagaggcggcctgaagaccgaggacctgagcgtgagagagtgcaccagctgcctgtgggagtgcgagaagaacaagatcgtgatcaagacccacggccccaagatcgtgagcgccaccgcctgcggcggcagaagctggaagagcgtgatgcagaagcccagcaccttcctggacctgccctaccccggcaacagcgagatcatcggcggcgacagaggcaaccacctgagcgagagaggcagcccctacaacatccacagcaccatccacagcccccccgaggacagcagagacgccagcgactgcatctactgcagacacggcctgctgaactaccagagccacagcgtggagagcgccatcctgctgagcaccgtggtggccaccatcctggccctgaccggcgtggtgctgagcagaagcaagagcgccgtgagattcctggccagcgccgtggccgtgcccttcagatgggtgagcctgctggtggtgtgggtgatgaagaagtggaaggccagagtggccaccgccatcagagccaccaacaacgccatcggctgggacaacggcctggagcaggccagagtggagaacgccgccagaagacagcagaccgccggcagatggagaagcctggacgccagcaccatcctgagcgtgctgagcaccggcctgtgctgcaccgagagcctgatcgccgagagcagcatcatgcagtgcaccaccggcgagggcagcaccacctgcaaggccaccggcaccgtggtgctgaagctgggccccatcggcagcgagagctgcctgatcctgaagggcctgagagacaacgagagacagttcatcagcatcaagaccatcagcagcgagctgacctgcagagagggcgagagcttctggacccccctgtacacccccgtgtgcctgagcagcagaagatgccacctgatgggcgagtgcaccggcgacatgtgcctgaagtggaagagcaacaagaccagcagcgagttcaccggcaagacccacagcgaggtgatccacgagaacaagtgcttcgagcagagcggcggcatcggctacatgtgcttcaacgtgaaccccagctgcctgatggtgcacagctacctgaagcccatctacaagaacgccttcaaggtgttcagatgcatcgcctggaaccacagagtgagactgggcatcaccacccacaagagaaagttcgaggtgaccctgatggccatgagcacccagcaggccgactggggcagcatcggcctgatcctggacagcgagggcatcagcggcaccaacagctacagcttcatgaagcacggcctgggcagctacgccatcatcgacgagccctacagcgtggagcccagaaagggctacctgggcgaggtgagatgccccaccgaggagaccgccatcaaggccagccccagctgcaaggtggcccccggcctggtggagtaccagcccgagatggacaccctggagtgcaccaccaacatgatggaccccatggccatcttcaacagaggcagcctgccccaggtgagaggcggctggaccttcagccagagcatcgagaagaacagcagacaggccctgaacaccggcgccatcaacgccagcgtgagacacgtgctggacgagtacgagttcgactacaaggtgaagaccaacgactgcgacagcaccttcgtgaacatcaccggctgctacagctgcgacgagggcgccagactgtgcgtgaaggtgagaaccagcagcgaggccatctaccacttcaccgacagcggctacaacatcaacgtgctgttcaaggtggagagcggcgtgcacgaccactgcaccatcctgcacttcagcaagcccgtgatcagcatcgagggcaagtacgactgcggcaagaacaagaagcccatgctgatcaagggcaccctgatcgccatggccccccacgacgacagagtggtgagcggcggcagcagcaccgtggtgaaccccaagggccagggcgtggacttcctgggctggctgagcagactgagcagctggttcggcggcggccccctgaagaccttcctgatggtgaccggcttcctgatgaccggcgtgatcggcggcatcgtgaccatcatcctgatcagaatcgtgctgcagcaggccctggccaagaaggtgaagtga

SEQ ID NO: 9764 - RNA, 4005 nt, synthetic construct
  misc_feature 1..4005: note = derived and/or modified CDS sequence (opt4) from Massilia virus(130)__KT906101.1__GP
  source 1..4005: mol_type = other RNA
atgttctacgccaagttcgtgatcagcctgtgcctggagcccggcttcagcctgaagtacaccatcatcagcaagagcggcagcggcaccatcagacagatctgcctgagccacagcaccgacatcgacaaggtgctggagctgagcagaggcgagatggacaccatcagcatcctgggcggcctgtgcaccttcggcgagctgaagagagaggactgcagccccgacgtgttcagcaactacgtggccaacatgtacggcaccacccaccccagcagctgcaagttcgtggacatcatcggcgacagaagcatcgaggtgctgaacgacgccgtgcccgacagcttcacccccggcgcccacaactgcagcagcttcgagaagaagcccttctggaccgacctgatccccgccaagaacagcagcggcgccatccccagcgtggtgagcgtgctgcccagcgtggccgagcacgacttcaacctgaaggtgaaggaggccaacgagaagctggaggtgatccagagagagctggccgccgagaaggccagaagcggcagactggaggacgaggccagagccaagatgaaggccctggaggacgagctgagaaacggctggctggccgagagagaggccaaggagctggccaagagcgccctggagaaggagagaatcaacaagctggaggtggagagaaagctgcacgacctgggcaagaagctgagacagagcgaggacgacgtggagaagatgagagtgcaccacaagaagagaagaaaggagagcgacgaggagatgaagatcgccaagaccaccgcccccagcgtgagcaccaccctggccaccgtggtgttcaccagcctgctggccaccggcctggccgccatcgagcccatcgaggacagaaacgtgaaccacatcctgaacagacccggcagcggcgtgtacatggccagccccaccctgacccagaacgagtgcagcctggactacggcaaggagtgcaaggcctgggagctgcaggtgagccccctgcactaccccttcttcaccagcaacgtggacaagtacagcatcctggagagcatcacccagagcagccccatcctgctgaagaacaacaacagctgcgagctgaccaccagccccggcacccagaagcagtgccagaaggagagcagcaccatcaagaagtactgcaccgacgacgccagagcctacttcttcatcgacctggagggcaagctgagcatcgtgcactgcaccaacaactacatcctgagcgaggactgcaacttctgcgtgagcaagctgggcgaggtgggccacaagatcttcatgcccatccaggacgccttctgccagaagggcggcagcgagagcatccccatcgtgagatacagcaaggacatctgcagcatcggcctgttcaagatcaagaactgccacaagagcaccagcagatacgagagaatgggcttcatcgtggccggcaagaagaagctgtacatcgaggagctgaagatgagatacagacaggagtacgacgaggaccagttcttctgctacaaggtgaagaagaccagccccctggagtacgccaaggtgagccccagcaagtgcaagggcgtgggcagcaacgagcagaagtgcaacggcgacgagtacttctgcaacagatacccctgcgagaccaacagccccgaggcccactgcagcctgagaagacacgccgccgtggtggaggtgtacgtgggcggcgcctggatcaagcccaagtgcgtgggctacgagaaggtgctggtgaagagaggcggcctgaagaccgaggacctgagcgtgagagagtgcaccagctgcctgtgggagtgcgagaagaacaagatcgtgatcaagacccacggccccaagatcgtgagcgccaccgcctgcggccacggcagctgcaagagcgtgatgcagaagcccagcaccttcctggacctgccctaccccggcaacagcgagatcatcggcggcgacagaggcaaccacctgagcgagagaggcagcccctacaacatccacagcaccatccactgcccccccgaggacagcagagacgccagcgactgcatctactgcagacacggcctgctgaactaccagagccacagcgtggccagcgccatcctgctgagcaccgtggtggccaccatcctggccctgaccggcgtggtgctgagcagaagcaagagcgccgtgagattcctggccagcgccgtggccgtgcccttcagatgggtgagcctgctggtggtgtgggtgatgaagaagtggaaggccagagtgaccaccgccatcagagccaccaacaacgccatcggctgggacaacggcctggagcaggtgagagtggagaacgccgccagaagacagcagcccgccgtgagatggagaagcctggacgccagcaccatcctgagcatcctgggcaccggcctgtgctgcaccgagagcctgatcgccgagagcagcatcatgcagtgcaccaccgaggagggcagcaccacctgcaaggccaccggcaccgtggtgctgaagctgggccccatcggcagcgagagctgcctgatcctgaagggcctgagagacaacgagaagcagttcatcagcatcaagaccatcagcagcgagctgacctgcagagagggcgagagcttctggaccagcctgtacacccccgtgtgcctgagcagcagaagatgccacctgatgggcgagtgcaccggcgacatctgcctgaagtggaagagcaacaagaccagcagcgagttcaccggcaagacccacagcgaggtgatccacgagaacaagtgcttcgagcagagcggcggcatcggctacatgtgcttcaacgtgaaccccagctgcctgatggtgcacagctacctgaagcccatctacaagaacgccttcaaggtgttcagatgcatcgcctggaaccacagagtgagactgggcatcaccacccacaagagaaagttcgagatcaccctgatggccatgagcacccagcagaccgactggggcagcatcggcctgatcctggacagcgagggcgtggccggcaccaacgcctacagcttcatgaagcacggcctgggcagcttcgccatcatcgacgagccctacagcgtggagcccagaaagggctacctgggcgaggtgaagggccccagagaggagaccgccatcaaggccagccccagctgccaggtggcccccggcctggtggagtaccagcccgtgatggacaccgtggagtgcaccaccaacatgatggaccccctggccatcttcaacagaggcagcctgccccaggtgagaggcggctggaccttcagccagagcatcgagaagaacagcctgcaggccctgaacaccggcgccatccacgccagcgtgagacacgtgctggacgagtacgagttcgagtacaaggtgaagagcaacgactgcgacagcaccttcgtgaacatcaccggctgctacagctgcgacgagggcgccagactgtgcgtgaaggtgagaaccagcagcgaggccatctaccacttcaccgacagcggctacaacatcaacgtgctgttcaaggtggacagcggcgtgcacgaccactgcaccatcctgcacttcagcaagcccgtgatcagcatcgagggcaagtacgactgcggcaagaacaagaagcccatgctgatcaagggcaccctgatcgccatggccccccacgacgacagagtggtgagcggcggcagcagcaccgtggtgaaccccaagggccagggcgtggacttcctgggctggctgagcggcctgagcagctggttcggcggcggccccctgaagaccttcctgatggtgaccggcttcctgatgaccggcgtgatcagcggcatcgtgaccatcatcctgatcagaatcgtgctgcagcaggccctggccaagaaggtgaagtga

SEQ ID NO: 9765 - RNA, 3999 nt, synthetic construct
  misc_feature 1..3999: note = derived and/or modified CDS sequence (opt4) from Massilia virus(W)__EU725772.1__GP
  source 1..3999: mol_type = other RNA
atgttctacgccaagttcgtgatcatcctgtgcctggtgcagggcttcagcctgaagtacaccatcatcagcaagagcggcagcggcaccatcagacagatctgcctgagccacagcaccgacatcgacaaggtgctggagctgagcagcggcgagatggacaccatcaacatccagggcggcctgtgcaccttcggcgagctgaagagagaggactgcagccccgacgtgttcagcaactacatcgccaacatgtacggcaccacccaccccagcagctgcagattcctggacatcatcggcgacagaagcatcgaggtgatgaacgacgccagccccgacagcttcacccccggcgcccacaactgcagcagcttcgagaaggcccccttctggagcgacctgatccccgccaagaacggcagcggccccagccccagcgtggtgagcgtgctgcccagcgccaccgagagcgacttcagcctgaaggtgaagaaggccaacgagagactggaggtgatccagagagagctggccgccgagaaggccagaagcggcagactggaggacgaggccagaaccaagatgagagccctggaggacgagctgagaaacggctggctggccgagagagaggccaaggagctggccaagagcgacctggagaaggagagagtgaacaagctggaggtggagagaaagctgcacgacctgaacaagaagctgagacagagcgaggacgaggccgagagactgagagagtaccacaacaagagaagaaaggagagcgacgagaagatgaagatgaccaagaccgtggcccccaacgtgagcaccaccctggccaccgtggtgctgaccagcctgctggccaccggcctggccgccatcgagcccatcgaggacagaaacaccaaccacatcctgaacagacccggcaccggcgtgtacatggccagccccaccctgaccgagaacgactgcagcctggactacggcaaggagtgcaaggcctgggagctgcaggtgagccccctgcactaccccttcttcaccagcaacgtggacaagtacagcctgctggagagcatcacccaggccagccccatcctgatcaagaacaacaacagctgcgagctgaccaccagccccggcagccagaagcagtgccagaaggagagcagcaccatcaagaagtactgcaccgacgacgccagagcctacttcttcgtggacctggagggcaacctgagcatcgtgcactgcagcaacaacaacatcctgagcgaggactgcaacttctgcatcagcaagagcggcgtgaccggccagaagatcttcatgcccatccaggacgccttctgccagagaggcggcagcgagagcctgcccgtgatcagatacagcaaggacatctgcagcatcggcctgttcaagatcaagagctgccacaagagcaccagcagatacgagagaatgggcttcatcgtggtgggcagaaagaagctgtacctggaggagctgaagatgagatacagacaggagtacgacgaggaccagttctactgctacaaggccaagaccaccagccagctgcagtaccagaaggtgagccccagcaagtgcaagggcgtgggcagcaaggaccagaagtgcaacggcgacgagtacttctgcaacagattcccctgcgagaccaacaaccccgacgcccactgcagcctgagaagacacgccgccgtggtggaggtgaacgtgggcggcgcctgggtgaagcccaagtgcgtgggctacgagaaggtgctggtgaagagaggcggcctgaagaccgaggacctgagcgtgagagagtgcaccagctgcctgtgggagtgcgagaagaacaagatcgtgatcaagacccacggccccaagatcgtgagcgccaccgcctgcagccacggcagctgcaagagcgtgatgcagaagcccagcaccttcctggacctgccctaccccggcaacagcgagatcatcggcggcgacatcggcatccacatgagcgagagaggcagccccagcaacatccacatcaccatccactgcccccccaaggacagctgcgacgtgagcgactgcatcttctgcagacacggcatcctgaactaccagtgccacagcgtggccagcgccatcctgctgagcaccgtggtggccaccatcctggccctgaccggcgtgatcatcagcagaagcaagttcgccgtgagattcctggccagcgccgtggccatccccttcagatgggtgagcctgctggtggtgtgggtgatgaagaagtggaagagcagaatcgccaccgccatcagagccaccaacaacgccatcggctgggacaacggcctggagcaggtgagagtggagaacgccgccagaagaccccagcccgccgtgagatacgccttctacgccaccaccatcctgagcatcctgggcagcggcctgtgctgcaccgagagcctgatcgccgagagcagcatcatgcagtgcaccaccgaggacagcagcaccacctgcaaggccaccggcaccgtggtgctgaagctgggccccatcggcagcgagagctgcctgatcctgaagggcctgagagacaacgagaagcagttcatcagcatcaagaccatcagcagcgagctgacctgcagagagggcgagagcttctggaccagcctgtacacccccgtgtgcctgagcagcagaagatgccacctgatgggcgagtgcaccggcgacatctgcctgaagtggaagagcaacaagaccagcagcgagttcaccggcaaggcccacagcgaggtgatccacgagaacaagtgcttcgagcagagcggcggcatcggctacggctgcttcaacgtgaaccccagctgcctgatggtgcacagctacctgaagcccatctacaagaacgccttcagagtgttcagatgcatcgcctggaaccacagagtgagactgggcgtgaccacccacaagagaaagttcgagatcaccctgatggccatgagcacccagcagaccgactggggcagcatcggcctgatcctggacagcgagggcatcgagggcaccaacgcctacagcttcatgaagcacggcctgggcagcttcgccatcgtggacgagccctacagcgtggagcccagaaagggctacctgggcgaggtgagatgccccaccgaggagaccgccatcaaggccagccccagctgcaaggtggcccccggcctgatcgagtaccagcccgagatggacaccgtggagtgcaccaccaacatgatggaccccatggccatcttcaacagaggcagcctgccccaggtgagagagggcaagaccttcacccagagcatcgagaagaacagcgtgcaggccctgaccaccggcgagatccacgccagcgtgagactggtgctggacgagtacgagatcgagtacaaggtgaccagcaacgactgcgacagcaccttcgtgaacatcaccggctgctacagctgcgacgagggcgccagactgtgcgtgaaggtgaagagcagcagcgaggccatctaccacttcaccgacagcagcttcagcgtgaacgtgctgttcaaggtgacccccagcgtgcacgactactgcaccatcctgcacttcagcagacccgtgatcagcatcgagggcaagtacgactgcggcaagaacaagaagcccatgctgatcaagggcaccctgatcgccatggccccccacgacgacagagtgatcaacggcggcagcagcaccgtggtgaaccccaagggccacggcgtggacttcctgggctggctgagcggcctgagcagctggttcggcggccccctgaagaccttcctgatggtgatgggcttcctgatgatcggcgtgatcatcgtgatcgtgaccatcatcctgatcagaatcggcctgcagcaggccctggccaagaagttcaagtga

SEQ ID NO: 9766 - RNA, 3996 nt, synthetic construct
  misc_feature 1..3996: note = derived and/or modified CDS sequence (opt4) from Punique virus(PI-B4-2008)__JF920134.1__GP
  source 1..3996: mol_type = other RNA
atgttctacgccaagttcgtgatcatcctgtgcctggtgcagggcttcagcctgaagtacaccatcatcagcaagctgggcagcggcaccaccagacaggtgtgcctgagccacagcaccgacctggacaaggtgctggagatcagcaacatggagatggacgccatcaacctgctgggcggcttctgcaccctgggcgagctgagaagagaggactgcagccccaacgtgttcagcaactacgtggtgaacgtgcacggcaccatccacagcagcaactgcaagttcgtggacatcgtgggcgacagaagcatcgaggtgctgaacgacgccacccccgacagcttcacccccggcgcccacaactgcagcagcttcgagaagccccccttctggaccgacctggtgcccaagaagaacgacaccgaccccagccccagcctgctgagcgtgctgcccgccgccgccgagctggacttcaacctgaagctgaaggaggccaacgacaaggtggaggccatccagagagagctggtggccgagaaggccagaagcggcagaatcgaggacgaggccagaaccaagatgagagagctggaggacgagctgagaagaggctggatcgccgagagagaggccaaggagctggcccacaagaacctggaggaggagagagtgagcaagctggagatcgagagaagaatgcacgacctggacaagaagctgagacagagcgagaacgacgccgacagactgagagagcagtacaacaagaagagaaagagcgaggaggaggtgaagacccccaaggccagcaccctgaacgccaccaccaccctggccaccgtggtgctgaccagcctgctggccaccggcctggccgccatcgagcagatcgaggagagaaacaccaaccacatcctgaacagacccggcaccggcgtgtacatggccagccccaccctgacccagaccgagtgcagcctgggctacggcaaggagtgcaagagctgggagctgcaggtgagccccctgcactaccccttcttcaccagcaacgtggacaagtacagcatcctggagagcatcacccaggagcccaccctgctgatcaagaacaacaacagctgcgagctgaccaccagccccggcagccagaagcagtgccagaaggagagcagcaccatcaagaagtactgcaccgacgacgccagagcctacttcttcatcgacctgggcggcaacctgagcatcgtgcactgcagcaacaacttcgtgctgagcgaggactgcaacttctgcatcagcaagagcggcggcgtgggccagaagatcttcatgcccatccaggacgccttctgccagagaggcggcagcgagagcccccccgtggtgagatacagcaaggacctgtgcagcatcggcctgttcaagatcaagagctgccacaagagcaccagcagatacgagagaatgggcttcatcgtggccggccagaagaagctgtacctggaggagctgaagatgagatacagacaggagtacgacgaggaccagttcttctgctacaaggtgaagagcaacagccccctgcagtacgagaaggtgagccccagcaagtgcaagggcgtgggcagccaggaccagaagtgcaacggcgacgagtacttctgcaacagatacccctgcgacaccaacaaccccgacgcccactgcagcctgagaagacacgccgccgtggtggaggtgaacgtgggcggcgtgtggatcaagcccaagtgcgtgggctacgagaaggtgctggtgaagagaggcggcctgaagaccgaggacctgagcgtgagagagtgcaccagctgcctgtgggagtgcgagagaaacaaggtggtggtgaagacccacggccccaagatcgtgagcgccaccgcctgcagccacggcagctgcaagagcgtgatgcagaagcccagcaccttcctggagatcccctaccccggcaacagcgagatcatcggcggcgacatcggcatccacatgagcgagagaggcagccccagcaacatccacgtggtggtgcactgcaagcccaaggacagctgcgacatcagcgactgcatcttctgcaagcacggcatcctgaactaccagtgccacagcgtggccagcgccgtgctgctgagcaccatgatcgccgcctgcctggccctggtgggcgtgatcgtgagcagaagcaagcacgccgtgaagttcctggccagcgtggtggccatccccttcaagtgggtgagcctgctgaccgtgtgggtggtgaagaactggaagctgagaatcaccagagtgatcagagccaccaacgacgccatcggctgggagaacaacctggagcaggtgagagtggagaacgccgccagaagaccccagcccgccgtgagatacgccttctacggcaccaccatcctgagcatcctgagcaccggcctgtgctgcagcgagagcctgatcgccgagagcagcatcatgcagtgcaccaccgaggacagcagcaccgtgtgcaaggccaccggcaccgtggtgctgaagctgggccccatcggcagcgagagctgcctgatcctgaagggcctgagagacaacgagaagcagttcatcagcatcaagaccatcagcagcgagctgacctgcagagagggcgagagcttctggaccagcctgtacacccccgtgtgcctgagcagcagaagatgccacctgatgggcgagtgcaccggcgacatctgcctgaagtggaagaccaacaagaccagcgccgagttcaccggcaagacccacagcgaggtgatccacgagaacaagtgcttcgagcagagcggcggcatgggctacggctgcttcaacgtgaaccccagctgcctgatggtgcacagctacctgaagcccatctacaagaacgccttcaaggtgttcagatgcgtggcctggaaccacagagtgagactgggcatcaccacccacaagagaaacttcgagatcaccctgatggccatgagcacccagcagaccgactggggcagcatcggcctgatcctggacagcgagggcatcaccggcaccaacagctacagcttcatgaagcacggcctgggcagcttcgccatcatcgacgagccctacgtgaccgagcccagaaagggctacctgggcgaggtgagatgccccaccgaggagaccgccgtgaaggccagccccagctgcaaggtggcccccggcctgatcgagtaccagcccgagatggacgtggtggagtgcaccaccaacatgatggaccccatggccatcttcaacagaggcagcctgccccaggtgagagacggcaagaccttcacccagagcatcgagaagagcagcgtgcaggccctgaccaccggcgagatccacgccagcgtgagactggtgctggacgagtacgaggtggagtacaaggtggtgaacaacgactgcgacagcaccttcgtgaacatcaccggctgctacagctgcgacgagggcgccagactgtgcgtgaaggtgaaggccagcagcgacgtgatctaccacttcaccgacagcgacaacagcatgaacgtgctgttcaaggtgagcagcaacatccaggactactgcatcgtgctgcacttcagcaagcccgtggtgaacgtggagggcaagtacgactgcggcagaagcaagaagcccatgctgatcaagggcaccctgatcgccatggccccccacgacgacagagtgaccaacggcggcagcagcatcatcatcaaccccaagggcggcggcgtggacttcctgggctggctgagcggcctgagcagctggttcggcggccccctgaagaccttcctgatcatcgccggcttcctgatcgtgggcatcatcatcgtgatcatcatcatcatcctggccagactgggcatccagcaggccctggccaagaagctgaagtga

SEQ ID NO: 9767 - RNA, 4020 nt, synthetic construct
  misc_feature 1..4020: note = derived and/or modified CDS sequence (opt4) from TOSV(9028)__KU904264.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcgacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacaagatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtgatcaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagctgaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgatcctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9768 - RNA, 4020 nt, synthetic construct
  misc_feature 1..4020: note = derived and/or modified CDS sequence (opt4) from TOSV(A189)__KP694241.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcagctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcaacgtggccagacccaccaacaagatggcccccatgagcgtgatccccccccccatcgtgaagcccatccccgtggccgagcccaccatcgagaagaccatccccttcgacaagctgctgagcgaggccgagaaggagctgaaccagaccaagatcagactggaggccgagagaagaagcaacgccgaggaggccgccaaggagagagccagaatgagagagatcgaggacaagctgagaaaggactgggagctggagagagagagaaaggacgccgtggccgacgacctggccaaggagatcgccagaagaagagagatcgagagaaaggcccacgagctggacaagatgctgaagaagaaggagagagaggacctggtggccagagagagagtgagcgaggacatgagaaaccacgtgagaagacccaacaccaccatcgcccccgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccgtgcccatcctgaacaagagcagcgccgtgtgcaccatctaccaccccagaatccacagaatggcctgcggcagagaggccagcctgatcaagaagaagtgcggcagcaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggaccgagagcatccccaacaccagatacagcaaggacctgtgcagcatcggcctgcacaccgtgaaggagtgcaagaccggcaccaccaacttcgagagagtgggcttcatcgtggtgaagggcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctgatgagaggcgccaaggacctggtgaagagactgttctactggctgatcacccccctgtgctggctgagcgtgttctgcagctggatgatcaagagctggaagaagagagtgggcagcgccatcagcagaaccaacgacaccatcggctggagagacaacagaagatacggccaggacgtggagagagcccagtacaccggcggcgcccccggcgccaagtacagcttctacggcgtgatgatcctgggcctgctgggcaacgtgcacagctgcagcgagagcgtgctggccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagagcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtgcagcaggccctgaagaagaagaacaagtga

SEQ ID NO: 9769 - RNA, 4020 nt, synthetic construct
  misc_feature 1..4020: note = derived and/or modified CDS sequence (opt4) from TOSV(AR)__EF656362.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccagcagcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacagaatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcaacagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaaggacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccaaggacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggatccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccgtgttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctgggtgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9770 - RNA, 4020 nt, synthetic construct
  misc_feature 1..4020: note = derived and/or modified CDS sequence (opt4) from TOSV(EsPhGR40)__FJ153283.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcggcaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgcccccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccagagagagagccagaatgagagacatcgaggaggagctgagaaaggagtgggagctggagagaaagagaaaggacgccatggccgacgacctggccaaggagaccgccaagagaagagagatcgagagaaaggcccacgagctggacagaatgctgaagaagaaggagagagagagcctgatcgccaaggagaaggaggacgagaacatgagaagcagagtgcacaagcccagcaccaccagagcccccgcccccaccatcatcaccaccctgctgatggccagcaccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccctgttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggaccgagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccgagagagagtgcgacagctgcctgtgggagtgcggcaagaacaagctgatcgtgaagacccacggccccaaggtggtgtacgccaccgcctgcagccacggcagctgcaagagcgtgatgcagaagcccaccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgctgctgggtggtgaagagctggaagagaagagtgggcagcgccatcagcagaaccaacgacaccatcggctggagagagaacagaagatacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaacgagaccagcgccgagttcaccggcaaggcccacggcgacgtgatgcacgagaacaagtgcttcgagcagagcggcggcatcggctacggctgcttcaacgtgaaccccagctgcctgtacgtgcacagctacctgaagagcgtgtacagaaacggcttcaagatcttcagatgcgtggcctggaaccacagaatcagactggaggtgaccacccagagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccgtgttccacttcatcaacgaggaggagagcatcaacgtgatcaacaaggtgagccccgacgtgagcgactactgcaccgtgctgcacttcagcagacccatcatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9771 - RNA, 4014 nt, synthetic construct
  misc_feature 1..4014: note = derived and/or modified CDS sequence (opt4) from TOSV(SI-121283)__JF330279.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctggaccgagttcatcaacgtggccaagcccgccaacgagatggcccccatgagcgtgatccccccccccatcgtgaagcccatccccgtggccgagagcaccaccaagaagaccatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatgggcagcgccgtgatggccggccccctggagaacagagagcccacccacctgctgaacagacccggcaacggcgcctaccccctgagcgacttcgccgagcccacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacatcgagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9772 - RNA, 4014 nt, synthetic construct
  misc_feature 1..4014: note = derived and/or modified CDS sequence (opt4) from TOSV(SI-121487)__JF330280.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctggaccgagttcatcaacgtggccaagcccgccaacgagatggcccccatgagcgtgatccccccccccatcgtgaagcccatccccgtggccgagagcaccaccaagaagaccatccccttcgacaagctgctgagcgaggccgagaaggagctgaaccagaccaagatcatgctggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatggccagcgccgtgatggccggccccctggagaacagagagatcaaccacctgctgaactggcccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacatcgagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagagcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtgcagcaggccctgaagaagaagaacaagtga

SEQ ID NO: 9773 - RNA, 4014 nt, synthetic construct
  misc_feature 1..4014: note = derived and/or modified CDS sequence (opt4) from TOSV(SI-21137)__EU003173.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccagaagacacaactgcagcgacctggacagaaagcccttctggaccgagttcatcaacgtggccaagcccgccaacgagatcgcccccatgagcgtgatccccccccccatcgtgaagcccatccccgtggccgagagcaccaccaagaagaccatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagaccaaccccagcaccagatacagcaaggacctgtgcagcatcggcctgcacaccgtgaaggagtgcaagatcggcaccaccaacttcgagagagagggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacatcgagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9774 - RNA, 4014 nt, synthetic construct
  misc_feature 1..4014: note = derived and/or modified CDS sequence (opt4) from TOSV(SI-31051)__EU003174.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctgcaccgagttcatcaacgtggccaagcccgccaacgagatggcccccatgagcgtgatccccccccccatcgtgaagcccatccccgtggccgagcccaccaccaagaagaccatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacatcgagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9775 - RNA, 4014 nt, synthetic construct
  misc_feature 1..4014: note = derived and/or modified CDS sequence (opt4) from TOSV(SI-39538)__EU003175.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctggaccgagttcatcaacgtggccaagcccgccaacgagatggcccccatgagcgtgatccccccccccatcgtgaagcccatccccgtggccgagagcaccaccaagaagaccatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacatcgagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagacacgaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9776 - RNA, 4014 nt, synthetic construct
  misc_feature 1..4014: note = derived and/or modified CDS sequence (opt4) from TOSV(SI-40463)__EU003176.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcaacgtggccaagcccgtgaacgagatggcccccatgagcgtgatccccccccccatcgtgaagcccatccccgtggccgagagcaccaccaagaagaccatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacatcgagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9777 - RNA, 4020 nt, synthetic construct
  misc_feature 1..4020: note = derived and/or modified CDS sequence (opt4) from TOSV(SI-40614)__EU003177.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcaacgtggccaagcccgccaacaagatcgcccccatcagcgtgatccccccccccatcgtgaagcccatccccatcgccgagagcaccatcaagaagaccatccccttcgacaagctgctgagcgaggccgagaaggagctgaaccagaccaagatcagactggagaccgagagaagaagcaacgccggcgaggccgccagagagagagccagaatgagagagatcgaggacaagctgagaaagaactgggagctggagagagagagaaaggacgccgtggccgacgacctggccaaggagatcgccagaagaagagagatcgagagaaaggcccacgagctggacaagatgctgaagaagaaggagagagaggaccaggtggccatcgagagagtgagcgaggacatgagaaaccacgtgagaagacccaacaccaccatcgcccccgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcaacaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagagaggctggaccgagagcatccccagcaccagatacagcaaggacctgtgcagcatcggcctgcacaccgtgaaggagtgcaagaccggcgccaccaacttcgagagagtgggcttcatcgtggtgaagagcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaagatggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgcggctggatgatcaagagctggaagaagagagtgggcagcgccatcagcagaaccaacgacaccatcggctggagagacaacagaagatacggcagagacgtggagagagcccagtacaccggcggcgtgcccggcgccatctacagcttctacggcgtgatgatcctgggcctgctgggcaacgtgcacagctgcagcgagagcgtgatcgccgacagcaaggtgatgcagtgcaccaccagcggcagcagcaccctgtgcaaggccagcggcaccgtgatcatgaagctgggccccatcggcagcgagagctgcctgatcctgaagggcctgaaggacaacgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagccccgagttcaccggcaaggcccacggcgaggtgatgcacgagaacagatgcttcgagcagagcggcggcatcggctacggctgcttcaacgtgaaccccagctgcctgtacgtgcacagcatcctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagagcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9778 - RNA, 4014 nt, synthetic construct
  misc_feature 1..4014: note = derived and/or modified CDS sequence (opt4) from TOSV(SI-51903)__EU003178.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctggaccgagttcatcaacgtggccaagcccgccaacgagatcgcccccatgagcgtgatccccccccccatcgtgaagcccatccccgtggccgagagcaccaccaagaagaccatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagaagaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacgccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggacgagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagaagagagtgggcagcgccatcagcagaaccaacgacaccatcggctggagagacaacagcagaagaggccaggacgtggagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggccccagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9779 - RNA, 4014 nt, synthetic construct
  misc_feature 1..4014: note = derived and/or modified CDS sequence (opt4) from TOSV(SI-68809)__EU003179.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctggaccgagttcatcgacgtggccaagcccgccaacgagatcgcccccatgagcgtgatccccccccccatcgtgaagcccatccccgtggccgagagcaccatcaagaagaccatccccttcgacaagctgctgagcgaggccgaggaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtgaacgaggacatgagaaaccacgtgagaagacccaacaccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagaccggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctggatgatcagaagctggaagagaagagtgggcagcgccatcagcagaaccaacgacaccatcggctggagagacaacagcagaagaggccaggacgtggagagagcccagtacaccggcggcgcccccggcgccaagtacagcttctacggcgtgatgatcctgggcctgctgggcgaggtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9780 - RNA, 4014 nt, synthetic construct
  misc_feature 1..4014: note = derived and/or modified CDS sequence (opt4) from TOSV(SI-76082)__EU003180.1__GP
  source 1..4014: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagagtgcaagagagacatcatgagcaactacgtggccgaggtgcacagcaacctgcacggcctgggcgccatgatgcacaactacggcgacgacaagagaatcgaggtgctgaacgacgtgatccccgacgagctgaaccccggcagacacaactgcagcgacctggacagaaagcccttctggaccgagttcatcaacgtggccaagcccgccaacgagatggcccccatgagcgtgatccccccccccatcgtgaagcccatccccgtggccgagagcaccaccaagaagaccatccccttcgacgagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgaggacctggccaaggagatcgccagaagaagagagatcgagagaaaggcccacgagctggacaagatgctgaagaagaaggagagagaggacctggtggccagagagagagtggacgaggacatgagaaaccacgtgagaagacccaacaccaccatcgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcgacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggagcgagagcatccccagcaccagatacagcaaggacctgtgcagcatcggcctgcacaccgtgaaggagtgcaagatcggcaccaccaacttcgagagagtgggcttcatcgtggtgaagggcagaaagatgtacatcgagcagatgaagatgagaagcagacaggagttcagcgaggaccagttcctgtgctacaagagcgagggcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatgacccccctgtgctggctgagcgtgttctgcggctggatgatcagaagctggaagaagagagtgggcagcgccatcagcagaaccaacgacaccatcggctggagagacaacagcagaagaggccaggacgtggagagagcccagtacaccggcggcgcccccggcgccaagtacagcttctacggcgtgatgatcctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgagatggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcggcggcatcaccggcaccaacgcctacagcttcatgaagcacggcctgggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagttcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtggagcaggccctgaagaagaagaacaagtga

SEQ ID NO: 9781 - RNA, 4020 nt, synthetic construct
  misc_feature 1..4020: note = derived and/or modified CDS sequence (opt4) from TOSV(TOSV/Mantova.ITA/2013)__KM507329.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcaacgtggccaagcccgccaacaagatcgcccccatcagcgtgatccccccccccatcgtgaagcccatccccatcgccgagagcaccatcaaggagaccatccccttcgagaagctgctgagcgaggccgagaaggagctgaaccagaccaagatcagactggagaccgagagaagaagcaacgccgaggaggccgccagagagagagccagagtgagagagatcgaggacaagctgagaaagaactgggagctggagagagagagaaaggacgccgtggccgacgacctggccaaggagatcgccagaagaagagagatcgagagaaaggcccacgagctggacaagatgctgaagaagaaggagagagaggaccaggtggccatcgagagagtgagcgaggacatgagaaaccacgtgagaagacccaacaccaccatcgcccccgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcaacaacatgagcgccttcttctacgtgaacctggccggccagatcaccgtggtgaagtgcgacaccaaccacgtgctgagcaacgactgcggcaactgcttcagcaagaccctgagcggccagaagatctacacccccgtgcaggacatgttctgccagagaggctggaccgagagcatccccagcaccagatacagcaaggacctgtgcagcatcggcctgcacaccgtgaaggagtgcaagaccggcaccaccaacttcgagagagtgggcttcatcgtggtgaagagcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaagatggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgcggctggatgatcaagagctggaagaagagagtgggcagcgccatcagcagaaccaacgacaccatcggctggagagacaacagaagatacggcagagacgtggagagagcccagtacaccggcggcgcccccggcgccaagtacagcttctacggcgtgatgatcctgggcctgctgggcaacgtgcacagctgcagcgagagcgtgatcgccgacagcaaggtgatgcagtgcaccaccagcggcagcagcaccctgtgcaaggccagcggcaccgtgatcatgaagctgggccccatcggcagcgagagctgcctgatcctgaagggcctgaaggacaacgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagagcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtgcagcaggccctgaagaagaagaacaagtga

SEQ ID NO: 9782 - RNA, 4020 nt, synthetic construct
  misc_feature 1..4020: note = derived and/or modified CDS sequence (opt4) from TOSV(TOSV/Phl.233/FR/2009)__HQ184337.1__GP
  source 1..4020: mol_type = other RNA
atgttcatcgccaagctgctgctgatcagctgcctggtgcagcaggcctacctgaagtacaccatcatcagcgagaccggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagccccagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacaagatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtgatcaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtgcagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9783 - RNA, 4020 nt, synthetic construct
  misc_feature 1..4020: note = derived and/or modified CDS sequence (opt4) from TOSV(TOSV/Phl.51/FR/2009)__HQ184336.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgacagaaaggcccacgagctggacagaatgctgaagaagaaggagagagagagcctgatcgccaaggagaaggccgacgagaacatgagaagccacgtgcacgagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagattcccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccgagagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttcttcggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctggtggagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccagagtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9784 - RNA, 4020 nt, synthetic construct
  misc_feature 1..4020: note = derived and/or modified CDS sequence (opt4) from TOSV(11368)__KU925897.1__GP
  source 1..4020: mol_type = other RNA
atgttcatcgccaagctgctgctgatcagctgcctggtgcagcaggcctacctgaagtacaccatcatcagcgagaccggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatggtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacaccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacaagatgctgaagaagaaggagagagagagcctgatcgccaaggagaaggccgacgaggacatgagaagccacgtgcacaagcccaacaccaccagagccctggcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtgatcaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtgcagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgatcctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9785 - RNA, 4020 nt, synthetic construct
  misc_feature 1..4020: note = derived and/or modified CDS sequence (opt4) from TOSV(5904242804)__KU935737.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcgacgtggccaagcccaccaacaagatcgcccccatgagcgtgatccccccccccatcgtgaagcccatccccgtggccgagagcaccatcaagaagagcatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgacgacctggccaaggagatcgccagaagaagagagatcgagagaaaggcccacgagctggacaagatgctgaagaagaaggagagagaggacctggtggccagagagagagtgagcgaggacatgagaaaccacgtgagaaagcccaacaccaccatcgcccccgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggaccgagagcatccccaacaccagatacagcaaggacctgtgcagcatcggcctgcacaccgtgaaggagtgcaagaccggcaccaccaacttcgagagagtgggcttcatcgtggtggagggcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtggatcgtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcggctgggtgatcaagagctggaagaagagagtgggcagcgccatcagcagaaccaacgacaccatcggctggagagacaacagaagatacagacaggacgtggagagagcccagtacaccggcggcgcccccggcgccaagtacagcttctacggcgtgatggtgctgggcctgctgggcaacgtgcacagctgcagcgagagcatcatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagcgccgagttcaccggcaaggcccacggcgaggtggtgcacgagaacagatgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagagcgactgcagcgccaccttcaagaacctgaccggctgctacagctgcgacgagggcagcagaatgtgctaccaggtgaaggccgagggcgagaccatcttccacttcatcaacgaggacgagagcatcaacgtgatcaacaaggtgaaccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctgatcgtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtgcagcaggccctgaagaagaagaacaagtga

SEQ ID NO: 9786 - RNA, 4020 nt, synthetic construct
  misc_feature 1..4020: note = derived and/or modified CDS sequence (opt4) from TOSV(5963930705)__KU935734.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgggcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggaggagctgagaagagagtgggagctggagagaaagagaaaggacgccatggccgacgacctggccaaggagaccgccagaagaagagagatcgagagaaaggcccacgagctggacagaatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagatacccctgcgaggccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccgagagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctggatggtgaagagctggaagagaagagtgggcagcgccatcagcagaaccaacgacaccatcggctggagagagaacagaagacacgcccaggacatcgagagagcccagcacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagccccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9787 - RNA, 4020 nt, synthetic construct
  misc_feature 1..4020: note = derived and/or modified CDS sequence (opt4) from TOSV(H4906)__KU922125.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagccccagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacagaatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagattcccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccgagagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggagatgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgaaccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9788 - RNA, 4020 nt, synthetic construct
  misc_feature 1..4020: note = derived and/or modified CDS sequence (opt4) from TOSV(MRS2010-4319501)__KC776215.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgatcagcggcacctgcaaggtgggcagcctggagaacagagactgcagaaaggacatcatgagcaactacgtggccgaggtgcacagcaacctgcacggcctgggcgccatgatgcacaactacgccgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacagaatgctgaagaagaaggagagagagagcctgatcgccaaggagaaggccgacgaggacatgagaagccacgtgtacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccaagtacagcaaggacatctgcagcatcggcctgcacaccgtgaaggagtgcaagatcggcatcaccagcttcgagagagtgggcttcatcgtggtgaagggcagaaagatgtacatcgagcagatgaagatgagaagcagacaggagtacagcgaggaccagttcctgtgctacaagagcgagagcagcagcggcagcagcgtgaagctgaagaagttcaaggtggagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagagtgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcgtgaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9789 - RNA, 4020 nt, synthetic construct
  misc_feature 1..4020: note = derived and/or modified CDS sequence (opt4) from TOSV(Nice/113)__KU204982.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcggcaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccagacccctgagcgagatcgcccccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacagaatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgggcggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccgagagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgctgctgggtgatcaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccgaggtgagcaactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9790 - RNA, 4020 nt, synthetic construct
  misc_feature 1..4020: note = derived and/or modified CDS sequence (opt4) from TOSV(P233)__KU204976.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagccccagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacaagatgctgaagaagaaggagagagagagcctgatcgccaaggagaaggccgacgaggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtgatcaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtgaagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttccactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9791 - RNA, 4020 nt, synthetic construct
  misc_feature 1..4020: note = derived and/or modified CDS sequence (opt4) from TOSV(T152)__JX867535.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcagctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcaacgtggccaagcccaccaacaagatcgcccccatcagcgtgatccccccccccatcgtgaagcccatccccatcgccgagcccaccaccaagaagaacatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgacgacctggccaaggagatcgccagaagaagagagatcgagagaaaggcccacgagctggacaagatgctgaagaagaaggagagagaggacctggtggccatcgagaaggtgagcgaggacatgagaaaccacgtgagaagacccaacaccaccatcgcccccgcccccaccatcatcaccaccctgctgctggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggaccgagagcatccccagcaccagatacagcaaggacctgtgcagcatcggcctgcacaccgtgaaggagtgcaagaccggcaccaccaacttcgagagagtgggcttcatcgtggtggagagcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtgggtggtgcccagatgcatcggctacgaggaggtgctggtgagaagaaccagcctgaaggtggaggacaccagcagcagagagtgcgacacctgcctgtgggagtgcggcaagaacaagctgatcgtgaagacccacggccccaagatcgtgtacgccaccgcctgcagccacggcagctgcaagagcgtgatgcagaagcccgccaccttcgtgttcctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagagactgttctactggctgatcacccccctgtgctggctgagcgtgttctgcagctggatgatcaagagctggagaaagagagtgggcagcgccatcagcagaaccaacgacaccatcggctggagagacaacagaagatacggccaggacgtggagagagcccagtacaccggcggcgcccccggcaccaagtacagcttctacggcgtgatgatcctgggcctgctgggcaacgtgcacagctgcagcgagagcgtgatcgccgacagcaaggtgatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagcgccgagttcaccggcaaggcccacggcgaggtgatgcacgagaacaagtgcttcgagcagagcggcggcatcggctacggctgcttcaacgtgaaccccagctgcctgtacgtgcacagctacctgaagagcgtgtacaagaacggcttcaagatcttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgaagcacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagagcgactgcagcgccaccttcaagaacctgaccggctgctacagctgcgacgagggcagcagaatgtgctaccaggtgaaggccgagggcgagaccatcttccacttcgtgaacgaggacgagagcatcaacgtgatcaacaaggtgagccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctggtggtgaaccccaagggcggcaccgtggacttcttcggctgggtgagcggcctgaccagctggctgggcggccccctgaagaccttcctgaccatcctgggcttcctggccctgggcctgctgctggtggtggtgatcatcatcatcgccagaaccggcgtgcagcaggccctgaagaagaagaacaagtga

SEQ ID NO: 9792 - RNA, 4020 nt, synthetic construct
  misc_feature 1..4020: note = derived and/or modified CDS sequence (opt4) from TOSV(TOSV/P51)__KU204979.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgacagaaaggcccacgagctggacagaatgctgaagaagaaggagagagagagcctgatcgccaaggagaaggccgacgagaacatgagaagccacgtgcacgagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtggtgaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctggtggagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgaccctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccagagtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9793 - RNA, 4020 nt, synthetic construct
  misc_feature 1..4020: note = derived and/or modified CDS sequence (opt4) from TOSV(TOSV_Italy/BB8/2014/human)__KY626661.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacatcaccgagagcatcggcctgaccagcggcacctgcaaggtgggcagcctggagaacagagactgcaagagagacatcatgagcaactacgtggccgaggtgcacagcaacctgcacggcctgggcgccatgatgcacaactacggcgacgacaagagagtggaggtgctgaacgacgtgatccccgacgagctgaaccccggcagacacaactgcagcgacctggacagaaagcccttctggaccgagttcatcgacgtggccaagcccaccaacaagatcgcccccatgagcgtgatccccccccccatcgtgaagcccatccccgtggccgagagcaccatcaagaagagcatccccttcgacaagctgctgagcgaggccgagaaggagctgaaccagaccaagatcagactggagaccgagagaagaagcaacgccgaggaggccgccaaggagagagccagaatgagagagatcgaggacaagctgagaaaggactgggagctggagagagagagaaaggacgccgtggccgacgacctggccaaggagatcgccagaagaagagagatcgagagaaaggcccacgagctggacaagatgctgaagaagaaggagagagaggacctggtggccagagagagagtgagcgaggacatgagaaaccacgtgtgcaagcccaacaccaccatcgcccccgcccccaccatcatcaccaccctgctgatggccagcgccgtgatggccggccccctggagaacagagagaccaaccacctgctgaacagacccggcaacggcgcctacaccctgagcgacttcgccgagagcacctgcaccctggcctacggcagcgagtgcaagagctgggagcaccagctggacgagctgagcttccccttcttccacagcaacctggacaagtacagcatgctggaggccgccaccgagaccatccccatcctgaacaagagcagcgccgtgtgcaccatcagccccagcacccacagcagcaacgcctgcggcagagaggccagcctgatcaagaagaagtgcggcagcaacatgagcgccttcttctacgtgaacctggccggccagatcaccgtggtgaagtgcgacaccaaccacgtgctgagcaacgactgcggcaactgcatcagcaagaccctgagcggccagaagatctacacccccgtgcaggacatgttctgccagaagggctggaccgagagcatccccaacaccagatacagcaaggacctgtgcagcatcggcctgcacagcgtgaaggagtgcaagaccggcaccaccaacttcgagagagtgggcttcatcgtggtgaagggcagaaagatgtacatcgagcagatgaagatgagaagcagacaggagttcagcgaggaccagttcctgtgctacaagagcgagagcagcagcggcagcagcgtgaagctgaagaaggtgaaggtggagagctgcaagggcgtgaccaccagcagcgccagcaagtgcagcggcgacgagtacttctgcagcagatacccctgcgagaccgccaacgtggaggcccactgcatcctgagaagacacagcgccgtgatcgaggtgaacgtgaacggcgtgtggatcgtgcccagatgcatcggctacgaggaggtgctggtgagaagaaccagcctgaaggtggaggacaccagcagcagagagtgcgacacctgcctgtgggagtgcggcaaggacaagctgatcgtgaagacccacggccccaagatcgtgtacgccaccgcctgcagccacggcagctgcaagagcgtgatgcagaagcccgccaccttcgtgtacctgccctaccccggcaacagcgagatcgtgggcggcgacatcggcgtgcacatgaccgaggagagcagccccagcaacatccacatggtggcccactgccccgccaaggacagctgcgaggtgagcagctgcctgttctgcgtgcacggcctgctgaactaccagtgccacaccctgttcagcgccctgctgatcagcaccaccgtgatgagcatcctgaccctgctgctgctgctgatgaagggcgccaaggacctggtgaagagactgttctactggctgatcacccccctgtgctggctgagcgtgttctgcggctgggtgatcaagagctggaagaagagagtgggcagcgccatcagcagaaccaacgacaccatcggctggagagacaacagaagatacagacaggacgtggagagagcccagtacaccggcggcgcccccggcgccaagtacagcttctacggcgtgatggtgctgggcctgctgggcaacgtgcacagctgcagcgagagcgtgatcgccgacagcaagatcatgcagtgcaccaccagcggcagcagcaccctgtgcaaggccagcggcaccgtgatcatgaagctgggccccatcggcagcgagagctgcctgatcctgaagggcctgaaggacagcgagaagcagttcatcagcatcaagaccatcagcagcgagctgacctgcagagagggcgagagcttctggaccaccctgtacacccccgtgtgcctgagcagcagaagatgccacctgatgggcgagtgcgtgagcgacagatgcctgaagtggaagaccaacgagaccagcgccgagttcaccggcaaggcccacggcgaggtgatgcacgagaacagatgcttcgagcagagcggcggcatcggctacggctgcttcaacgtgaaccccagctgcctgtacgtgcacagctacctgaagagcgtgtacaagaacggcttcaagaccttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacgcctacagcttcatgagacacggcagcggcagcttcgccatcatcgacgacccctacagccccgagcccagaaagggcttcctgggcgaggtgagatgccccaccgaggagaccgccatcagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgagagccagcatcagactgaccctggacgactacgacgtggtgtaccagaacagccagagcgactgcagcgccaccttcaagaacctgaccggctgctacagctgcgacgagggcagcagaatgtgctaccaggtgaaggccgagggcgagaccatcttccacttcatcaacgaggacgagagcatcaacgtgatcagcaaggtgaaccccgacgtgagcgactactgcaccgtgctgcacttcagcagacccgtgatcagcatcgagggcagatacgactgcggcctgagcaagagacccatggtgatcaagggcaccctgatcgccaccgccccccacgacgacagaaagcacgagggcggcagcagcctgatcgtgaaccccaagggcggcaccgtggacttcttcggctgggtgagcggcctgaccagctggctgggcggccccctgaagaccttcctgaccatcctgggcttcctggccctgggcctgctgctggtggtgatcatcatcatcatcgccagaaccggcgtgcagcaggccctgaagaagaagaacaagtga

SEQ ID NO: 9794 - RNA, 4020 nt, synthetic construct
  misc_feature 1..4020: note = derived and/or modified CDS sequence (opt4) from TOSV(TOSV-54441132704)__KX010933.1__GP
  source 1..4020: mol_type = other RNA
atgttcatcgccaagctgctgctgatcagctgcctggtgcagcaggcctacctgaagtacaccatcatcagcgagatcggcaacggcaccagaaccagcttctgctacagcagcagaaccagcctgggcagcctgctggaggcctgggacaacgtgaccgagagcatcggcctgaccagcggcacctgcaaggtgggcagcctggagaacagagactgcagaaaggacatcatgagcaactacgtggccgaggtgcacagcaacctgcacggcctgggcgccatgatgcacaactacggcgacgacaagagagtggagatcctgaacgacgtgatccccgacgagctgaaccccggccaccacaactgcagcgacctggacagaaagcccttctggaccgagttcatcaacgtggccaagcccctgagcgagatcgtgcccatgagcgtgatccccccccccgtggtgaagctgcagccccccgccgagcccagcagcaagaagcacgtgcccttcgacgtgctgctgagcgaggccgagaaggagctgaaccagaccaagatcagactggaggacgagagaaagagcaacgccgaggagaccgccaaggagagagccagaatgaaggagatcgaggacgagctgagaagagagtgggagctggagagaaagagaaaggacgccatggccgacgacctggccaaggagaccgccagaagaagagagatcgagagaaaggcccacgagctggacaagatgctgaagaagaaggagagaaagagcctgatcgccaaggagaaggccgacgtggacatgagaagccacgtgcacaagcccaacaccaccagagcccccgcccccaccatcatcaccaccctgctgatggccagcgccgccctggccggccccctggagaacagagagaccaaccacctgctgaacagacccggcaacggcgcctacaccctgagcgacttcgccgagagcacctgcaccctggcctacggcagcgagtgcaagagctgggagcacctgctgaacgaggagctgttccccttcttccacagcaacctggacaagtacagcatgctggaggccgccaccgagaccgtgcccatcctgaacaagagcagcgccgtgtgcaccatcagccccagcacccacagcagcaacgcctgcggcagagaggccagcgtgatcagaaagaagtgctacagcaacatgagcgccttcttctacatcaacctggccggccagatcaccgtgatcaagtgcgagaccaaccacgtgctgagcagcgactgcggcaactgcatcagcaagagcctgagcggccagaaggtgtacacccccgtgcaggacgtgttctgccagaagggctggacccagagcatccccagcaccagatacagcaaggacatctgcagcatcggcctgcacaccgtgaaggagtgcaagatcggcaccaccagcttcgagagagtgggcttcatcgtggtgaagggcagaaagatgtacatcgagcagatgaagatgagaagcagacaggagtacagcgaggaccagttcctgtgctacaagagcgagagcggcagcggcagcagcgtgaagctgaagaagttcaaggtggagagctgcaagggcgtgaccaccagcagcgccagcaagtgcagcggcgacgagtacttctgcagcagatacccctgcgagaccgccaacgtggaggcccactgcatcctgagaagacacagcgccatcgtggaggtgaacgtgaacggcgtgtgggtggtgcccagatgcatcggctacgaggaggtgctggtgaagagaaccagcctgaaggtggaggacaccaccggcagagagtgcgacagctgcctgtgggagtgcggcaagaacaagctgatcgtgaagacccacggccccaaggtggtgtacgccaccgcctgcagccacggcagctgcaagagcgtgatgcagaagcccgccaccttcgtgtacctgccctaccccggcaacagcgagatcgtgggcggcgacatcggcatccacatgaccgaggagagcagccccagcaacatccacctggtggcccactgccccgccagagacagctgcgacgtgagcgactgcctgttctgcgtgcacggcctgctgaactaccagtgccacaccctgttcagcgccctgctgatcagcaccaccgtgatgagcatcctgaccctgctgctgctgctggtgaagggcgccaaggacctggtgaagaagctgttctactggctgatcacccccctgtgctggctgagcgtgttctgctgctgggtggtgaagagctggaagagaagagtgggcagcgccatcagcagaaccaacgacaccatcggctggagagagaacagaagacacgcccaggacatcgagagagcccagtacaccggcggcgcccccggcgccaagtacagcttctacggcgtgatgatcctgggcctgctgagcagcgcccagagctgcagcgagagcgtgatcgccgacagcaagatcatgcagtgcaccaccagcggcagcagcaccctgtgcaaggccagcggcaccgtgatcatgagactgggccccatcggcagcgagagctgcctgatcctgaagggcctgaaggacagcgagaagcagttcatcagcatcaagaccatcagcagcgagctgacctgcagagagggcgagagcttctggaccaccctgtacacccccatctgcctgagcagcagaagatgccacctgatgggcgagtgcgtgagcgacagatgcctgaagtggaagaccaaccagaccagcgccgagttcaccggcaaggcccacggcgacgtgatgcacgagaacagatgcttcgagcagagcggcggcatcggctacggctgcttcaacgtgaaccccagctgcctgtacgtgcacagctacctgaagagcgtgtacagaaacggcttcaaggtgttcagatgcgtggcctggaaccacagaatcagactggaggtgaccacccacagcagaaagttccccatggtgctgatggccatgagcacccagcccaccgactggggcagcatcggcctgatcctggacagcgagggcatcaccggcaccaacagctacagcttcatgaagcacggcagcggcagcttcgccatcatcgacgacccctacagccccgagcccagaaagggcttcctgggcgaggtgagatgccccaccgaggagaccgccatgagagccagccccagctgcaagatggcccccaacctgatcgagtaccagcccgagatggacaccgccgagtgcaccaccaacatgatcgaccccatggccatcttcaacagaggcagcctgccccaggtgagagacggcatgaccttcacccagagcatcgagaagaacaccgtgcaggccctgaccaccggcgaggtgaaggccagcatcagactgatcctggacgactacgacgtggtgtaccagaacagccagagcgactgcagcgccaccttcaagaacctgaccggctgctacagctgcgacgagggcagcagactgtgctaccaggtgaaggccgagggcgagaccatcttccacttcatcaacgaggaggagagcatcaacgtgatcaacaaggtgagccccggcgtgagcgactactgcaccgtgctgcacttcagcagacccgtgatcagcatcgagggcacctacgactgcggcctgagcaagagacccatggtgatcaagggcaccctgatcgccaccgccccccacgacgacagaaagcacgagggcggcagcagcctggtggtgaaccccaagggcggcagcgtggacttcttcggctggctgagcggcctgaccagctggctgggcggccccctgaagaccttcctgaccatcctgggcttcctggccgtgggcctgctgctggtggtgatcatcatcatcatcatcagaaccggcatgcagcaggccctgaagaagaagatcaagtga

SEQ ID NO: 9795 - RNA, 3222 nt, synthetic construct
  misc_feature 1..3222: note = derived and/or modified CDS sequence (opt4) from SFTSV(HB29)__NC_018138.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcaccagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagactgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9796 - RNA, 3222 nt, synthetic construct
  misc_feature 1..3222: note = derived and/or modified CDS sequence (opt4) from SFTSV(Jilin)__KT890281.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggcccccctggaggtgaacccccccgagcagagaatcggccagtgcaccggctgccacctggagtgcatcaacggcggcgtgagactgatcaccctgaccagcgagctgaagagcgccaccgtgtgcgcctaccacttctgcagctgcgccaccagcggcaagaagagcaccgagatccagttccacagcggcagcctggtgggcaagaccgccatccacgtgaagggcgccctggtggacggcaccgagttcaccttcgagggcagatgcatgttccccgacggctgcgacgccgtggactgcaccttctgcagagagttcctgaagaacccccagtgctaccccgcccagaagtggctgttcatcatcatcgtgatcctgctgggctacgccggcctgatgctgctgaccaacgtgctgaaggccatgggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatccagaccatcgtggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9797 - RNA, 3222 nt, synthetic construct
  misc_feature 1..3222: note = derived and/or modified CDS sequence (opt4) from SFTSV(05-Lu'an(CHN)-2015)__KX302597.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcggcgccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctacctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9798 - RNA, 3222 nt, synthetic construct
  misc_feature 1..3222: note = derived and/or modified CDS sequence (opt4) from SFTSV(07-Lu'an(CHN)-2015)__KX302598.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9799 - RNA, 3222 nt, synthetic construct
  misc_feature 1..3222: note = derived and/or modified CDS sequence (opt4) from SFTSV(12-Lu'an(CHN)-2014)__KX302595.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaaggtggacggcatcgtgttcaaccagtgcgacagcgagagcctgccccagcccatcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatggcccccgtgaagctgatgttcgccatcatgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagctacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcagaggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgatcagaagcagaaccaagctggcctga

SEQ ID NO: 9800 - RNA, 3222 nt, synthetic construct
  misc_feature 1..3222: note = derived and/or modified CDS sequence (opt4) from SFTSV(14-Lu'an(CHN)-2014)__KX302596.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaaggtggacggcatcgtgttcaaccagtgcgacagcgagagcctgccccagcccatcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatggcccccgtgaagctgatgttcgccatcatgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcagaggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgttcagaagcagaaccaagctggcctga

SEQ ID NO: 9801 - RNA, 3222 nt, synthetic construct
  misc_feature 1..3222: note = derived and/or modified CDS sequence (opt4) from SFTSV(18-Lu'an(CHN)-2015)__KX302599.1__GP
  source 1..3222: mol_type = other RNA
atgatgaaggtgatctggttcttcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacagaggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacgtgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcatcacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9802 - RNA, 3222 nt, synthetic construct
  misc_feature 1..3222: note = derived and/or modified CDS sequence (opt4) from SFTSV(27-Lu'an(CHN)-2015)__KX302600.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9803 - RNA, 3222 nt, synthetic construct
  misc_feature 1..3222: note = derived and/or modified CDS sequence (opt4) from SFTSV(36-Lu'an(CHN)-2015)__KX302601.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtggtgctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9804 - RNA, 3222 nt, synthetic construct
  misc_feature 1..3222: note = derived and/or modified CDS sequence (opt4) from SFTSV(42-Lu'an(CHN)-2015)__KX302602.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggcttcagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcagaatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtgagcaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9805 - RNA, 3222 nt, synthetic construct
  misc_feature 1..3222: note = derived and/or modified CDS sequence (opt4) from SFTSV(44-Lu'an(CHN)-2015)__KX302603.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggcttcagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtgagcaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9806 - RNA, 3222 nt, synthetic construct
  misc_feature 1..3222: note = derived and/or modified CDS sequence (opt4) from SFTSV(52-Lu'an(CHN)-2015)__KX302604.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagagaagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9807 - RNA, 3222 nt, synthetic construct
  misc_feature 1..3222: note = derived and/or modified CDS sequence (opt4) from SFTSV(HL/Injected)__KF791953.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9808 - RNA, 3222 nt, synthetic construct
  misc_feature 1..3222: note = derived and/or modified CDS sequence (opt4) from SFTSV(HL/Larvae/G2)__KF791955.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcagaaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9809 - RNA, 3222 nt, synthetic construct
  misc_feature 1..3222: note = derived and/or modified CDS sequence (opt4) from SFTSV(JS2011-004)__KC505124.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcggcggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatgaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9810 - RNA, 3222 nt, synthetic construct
  misc_feature 1..3222: note = derived and/or modified CDS sequence (opt4) from SFTSV(JS2011-013-1)__KC505127.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaagtacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcggccacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9811 - RNA, 3222 nt, synthetic construct
  misc_feature 1..3222: note = derived and/or modified CDS sequence (opt4) from SFTSV(JS2011-027)__KC505130.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacgagcccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatgggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcatcaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9812 - RNA, 3222 nt, synthetic construct
  misc_feature 1..3222: note = derived and/or modified CDS sequence (opt4) from SFTSV(JS2011-034)__KC505133.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagctgctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgctgaagctgggcaccaagcaggtgtacagaagcagaaccaagctggcctga

SEQ ID NO: 9813 - RNA, 3222 nt, synthetic construct
  misc_feature 1..3222: note = derived and/or modified CDS sequence (opt4) from SFTSV(JS2011-062)__KC505136.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgtgaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctgatgggcaagctgatcgacagaggcagacaggtgatccacgaggagatcggcgagaacggcgagggcaacagagacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcctgatcggcgtgctgctgggcggcctggccctgttcttcctgatcatgagcctgttcaagctgggcaccaagcaggtgttcagaagcagaaccaagctggcctga

SEQ ID NO: 9814 - RNA, 3222 nt, synthetic construct
  misc_feature 1..3222: note = derived and/or modified CDS sequence (opt4) from SFTSV(JS2011-109)__KC505139.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9815 - RNA, 3222 nt, synthetic construct
  misc_feature 1..3222: note = derived and/or modified CDS sequence (opt4) from SFTSV(JS2011-13-2)__KR230770.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9816 - RNA, 3222 nt, synthetic construct
  misc_feature 1..3222: note = derived and/or modified CDS sequence (opt4) from SFTSV(JS2011-69)__KR230771.1__GP
  source 1..3222: mol_type = other RNA
atgatgaaggtgatctggttcagcagcctggtgtgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgacagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatggcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccgtgagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgttcagaagcagaaccaagctggcctga

SEQ ID NO: 9817 - RNA, 3222 nt, synthetic construct
  misc_feature 1..3222: note = derived and/or modified CDS sequence (opt4) from SFTSV(JS2012-020)__KC505142.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcggcggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgggccccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcatcatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgagctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9818 - RNA, 3222 nt, synthetic construct
  misc_feature 1..3222: note = derived and/or modified CDS sequence (opt4) from SFTSV(JS2012-035)__KC505145.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctgggcgtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9819 - RNA, 3222 nt, synthetic construct
  misc_feature 1..3222: note = derived and/or modified CDS sequence (opt4) from SFTSV(JS2012-79)__KR230772.1__GP
  source 1..3222: mol_type = other RNA
atgatgaaggtgatctggttcagcagcctgacctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgagcgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcggccacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9820 - RNA, 3222 nt, synthetic construct
  misc_feature 1..3222: note = derived and/or modified CDS sequence (opt4) from SFTSV(JS2013-44)__KR230773.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcagcgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcagcatgatcatgagcctgttcaagctgggcaccaagcaggtgttcagaagcagaaccaagctggcctga

SEQ ID NO: 9821 - RNA, 3222 nt, synthetic construct
  misc_feature 1..3222: note = derived and/or modified CDS sequence (opt4) from SFTSV(JS2013-46)__KR230774.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacgagcccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatgggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcatggcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcatcaactacagaggcctgagactgagcctgagcgagatcagcgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9822 - RNA, 3222 nt, synthetic construct
  misc_feature 1..3222: note = derived and/or modified CDS sequence (opt4) from SFTSV(JS2013-52)__KR230775.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgttcagaagcagaaccaagctggcctga

SEQ ID NO: 9823 - RNA, 3222 nt, synthetic construct
  misc_feature 1..3222: note = derived and/or modified CDS sequence (opt4) from SFTSV(JS2013-69)__KR230776.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatcatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccctggagagcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgttcagaagcagaaccaagctggcctga

SEQ ID NO: 9824 - RNA, 3222 nt, synthetic construct
  misc_feature 1..3222: note = derived and/or modified CDS sequence (opt4) from SFTSV(JS2013-71)__KR230777.1__GP
  source 1..3222: mol_type = other RNA
atgatgaaggtgatctggttcagcagcctgatctgcttcgtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9825 - RNA, 3222 nt, synthetic construct
  misc_feature 1..3222: note = derived and/or modified CDS sequence (opt4) from SFTSV(JS2014-03)__KR230778.1__GP
  source 1..3222: mol_type = other RNA
atgatgaaggtgatctggttcagcagcctgatctacttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcagagtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9826 - RNA, 3222 nt, synthetic construct
  misc_feature 1..3222: note = derived and/or modified CDS sequence (opt4) from SFTSV(JS2014-16)__KR230780.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaaggtggacggcatcgtgttcaaccagtgcgacagcgagagcctgccccagcccatcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatggcccccgtgaagctgatgttcgccatcatcaagaagctgatgagaagcgtgagctgcatgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgctgtgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcagaggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgttcagaagcagaaccaagctggcctga

SEQ ID NO: 9827 - RNA, 3222 nt, synthetic construct
  misc_feature 1..3222: note = derived and/or modified CDS sequence (opt4) from SFTSV(JS2014-18)__KR230781.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccaccacccccatccccgaggagaccttcctggagctgaagagcttcagccagagcgagttccccgacgtgtgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9828 - RNA, 3222 nt, synthetic construct
  misc_feature 1..3222: note = derived and/or modified CDS sequence (opt4) from SFTSV(JS2014-31)__KR230782.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcgtgctggccctgttcttcctgatcatgagcctgttcaagctgggcaccaagcaggtgttcagaagcagaaccaagctggcctga

SEQ ID NO: 9829 - RNA, 3222 nt, synthetic construct
  misc_feature 1..3222: note = derived and/or modified CDS sequence (opt4) from SFTSV(JS2014-33)__KR230783.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcaactgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagagccgtgggctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcggcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcgccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggccttcagaagcagaaccaagctggcctga

SEQ ID NO: 9830 - RNA, 3222 nt, synthetic construct
  misc_feature 1..3222: note = derived and/or modified CDS sequence (opt4) from SFTSV(JS2014-39)__KR230784.1__GP
  source 1..3222: mol_type = other RNA
atgatgaaggtgatctggttcagcagcctgacctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcagcgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcagcatgatcatgagcctgttcaagctgggcaccaagcaggtgttcagaagcagaaccaagctggcctga

SEQ ID NO: 9831 - RNA, 3222 nt, synthetic construct
  misc_feature 1..3222: note = derived and/or modified CDS sequence (opt4) from SFTSV(JS2014-H.longicornis-02)__KR230786.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgtggaggccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgccccgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9832 - RNA, 3222 nt, synthetic construct
  misc_feature 1..3222: note = derived and/or modified CDS sequence (opt4) from SFTSV(JS2014-H.longicornis-03)__KR230787.1__GP
  source 1..3222: mol_type = other RNA
atgatgaaggtgatctggttcagcagcctgacctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9833 - RNA, 3222 nt, synthetic construct
  misc_feature 1..3222: note = derived and/or modified CDS sequence (opt4) from SFTSV(JS2014-Hedgehog-02)__KR230789.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9834 - RNA, 3222 nt, synthetic construct
  misc_feature 1..3222: note = derived and/or modified CDS sequence (opt4) from SFTSV(KACNH)__KU507558.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccagcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgacgccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcctgatcgtgatcctgctgggctacgccggcctgatgctgatcaccaacgtgctgaaggccatcggcgtgtggggcagctgggtgatcgcccccgtgaagctgatgttcgccatcatcaagaagctgatgagaaccgtgagctgcctgatgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9835 - RNA, 3222 nt, synthetic construct
  misc_feature 1..3222: note = derived and/or modified CDS sequence (opt4) from SFTSV(KACNH2)__KU507559.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagagaacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacatcgagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcggcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcatccacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9836 - RNA, 3222 nt, synthetic construct
  misc_feature 1..3222: note = derived and/or modified CDS sequence (opt4) from SFTSV(KACNH3)__KP663744.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcggcgccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgaggtgaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9837 - RNA, 3222 nt, synthetic construct
  misc_feature 1..3222: note = derived and/or modified CDS sequence (opt4) from SFTSV(KADGH)__KU507548.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctggcccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgtggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgtgctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcagactgcacagcagcaagaacagcaccgcccacgtgagatgcaaggaggacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9838 - RNA, 3222 nt, synthetic construct
  misc_feature 1..3222: note = derived and/or modified CDS sequence (opt4) from SFTSV(KAGBH)__KU507560.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatcagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9839 - RNA, 3222 nt, synthetic construct
  misc_feature 1..3222: note = derived and/or modified CDS sequence (opt4) from SFTSV(KAGBH3)__KU507561.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagaatcatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgctgtgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacgccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9840 - RNA, 3222 nt, synthetic construct
  misc_feature 1..3222: note = derived and/or modified CDS sequence (opt4) from SFTSV(KAGBH4)__KU507562.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9841 - RNA, 3222 nt, synthetic construct
  misc_feature 1..3222: note = derived and/or modified CDS sequence (opt4) from SFTSV(KAGBH5)__KP663738.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccctgtacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagatgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccgtgggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctggccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9842 - RNA, 3222 nt, synthetic construct
  misc_feature 1..3222: note = derived and/or modified CDS sequence (opt4) from SFTSV(KAGBH6)__KP663741.1__GP
  source 1..3222: mol_type = other RNA
atgatcaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatcagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcagcgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggccttcagaagcagaaccaagctggcctga

SEQ ID NO: 9843 - RNA, 3222 nt, synthetic construct
  misc_feature 1..3222: note = derived and/or modified CDS sequence (opt4) from SFTSV(KAGNH)__KU507550.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggcagaagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatcagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaagatcagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaaccaggtgttcagaagcagaaccaagctggcctga

SEQ ID NO: 9844 - RNA, 3222 nt, synthetic construct
  misc_feature 1..3222: note = derived and/or modified CDS sequence (opt4) from SFTSV(KAGNH4)__KU507551.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccggcggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcagaaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcctgctgatcatgagcctgttcaagctgggcaccaagcaggtgttcagaagcagaaccaagctggcctga

SEQ ID NO: 9845 - RNA, 3222 nt, synthetic construct
  misc_feature 1..3222: note = derived and/or modified CDS sequence (opt4) from SFTSV(KAGWH2)__KU507564.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacgtgtgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9846 - RNA, 3222 nt, synthetic construct
  misc_feature 1..3222: note = derived and/or modified CDS sequence (opt4) from SFTSV(KAGWH3)__KP663735.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctgatcgtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgaggtgagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcagactgggcaccaagcaggtgttcagaagcagaaccaagctggcctga

SEQ ID NO: 9847 - RNA, 3222 nt, synthetic construct
  misc_feature 1..3222: note = derived and/or modified CDS sequence (opt4) from SFTSV(KAICH)__KU507565.1__GP
  source 1..3222: mol_type = other RNA
atgatgaaggtgatctggttcagcagcctgatctgcctggtgatccagtgcggcggcgacaccagccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatggaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtgaccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagcaaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggttcctgggcgtgatcggcgtgctgctgggcggcctggccctgttcttcctgatcatgagcctgttcaagctgggcaccaagcaggtgttcagaagcagaagcaagctggcctga

SEQ ID NO: 9848 - RNA, 3222 nt, synthetic construct
  misc_feature 1..3222: note = derived and/or modified CDS sequence (opt4) from SFTSV(KAJJH)__KU507566.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagagaacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacatcgagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcggcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9849 - RNA, 3222 nt, synthetic construct
  misc_feature 1..3222: note = derived and/or modified CDS sequence (opt4) from SFTSV(KAJNH2)__KU507552.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtgctgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaacagagacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagagccaagctggcctga

SEQ ID NO: 9850 - RNA, 3222 nt, synthetic construct
  misc_feature 1..3222: note = derived and/or modified CDS sequence (opt4) from SFTSV(ZL13-32)__KU361342.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9851 - RNA, 3222 nt, synthetic construct
  misc_feature 1..3222: note = derived and/or modified CDS sequence (opt4) from SFTSV(AHL/China/2011)__JQ670930.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagaacaccgagatccagttccacagcggcagcctggtgggcaagaccgccatccacgtgaagggcgccctggtggacggcaccgacttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccaccggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcgtgaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9852 - RNA, 3222 nt, synthetic construct
  misc_feature 1..3222: note = derived and/or modified CDS sequence (opt4) from SFTSV(AH-YTY/China/05/2012)__KR017849.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9853 - RNA, 3222 nt, synthetic construct
  misc_feature 1..3222: note = derived and/or modified CDS sequence (opt4) from SFTSV(AHZ/China/2011)__JQ670931.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatcctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaagatcgccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagtggatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgagcatgcccagcggcgaggtgagaaccttccaccccatgagcggcatccccacccaggtgttcaagggcgtgagcgtgacctacctgggcagcgacatggaggtgagcggcctgaccggcctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggagagcgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcctgatcggcgtgctgctgggcggcctggccctgttcttcatgatcatgagcctgttcaagctgggcaccaagcaggtgttcagaagcagaaccaagctggcctga

SEQ ID NO: 9854 - RNA, 3222 nt, synthetic construct
  misc_feature 1..3222: note = derived and/or modified CDS sequence (opt4) from SFTSV(DS02/CHN/2013)__KR698332.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacctgcagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9855 - RNA, 3222 nt, synthetic construct
  misc_feature 1..3222: note = derived and/or modified CDS sequence (opt4) from SFTSV(DS03/CHN/2013)__KR698333.1__GP
  source 1..3222: mol_type = other RNA
atgatgaaggtgatctggttcagcagcctgatctacctggtgatccagtgcagcggcgacagcggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagagagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcagaaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacatcagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9856 - RNA, 3222 nt, synthetic construct
  misc_feature 1..3222: note = derived and/or modified CDS sequence (opt4) from SFTSV(DS04/CHN/2013)__KR698334.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttcagacccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggtgaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9857 - RNA, 3222 nt, synthetic construct
  misc_feature 1..3222: note = derived and/or modified CDS sequence (opt4) from SFTSV(DS05/CHN/2013)__KR698335.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgccacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9858 - RNA, 3222 nt, synthetic construct
  misc_feature 1..3222: note = derived and/or modified CDS sequence (opt4) from SFTSV(HB154/China/2011)__JQ733560.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatcaacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcagcctgatcatgttcctgctgaagctgggcaccaagcaggtgttcagaagcagaaccaagctggcctga

SEQ ID NO: 9859 - RNA, 3222 nt, synthetic construct
  misc_feature 1..3222: note = derived and/or modified CDS sequence (opt4) from SFTSV(HB155/China/2011)__JQ733563.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccagattcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9860 - RNA, 3222 nt, synthetic construct
  misc_feature 1..3222: note = derived and/or modified CDS sequence (opt4) from SFTSV(HB156/China/2011)__JQ733566.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaatccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9861 - RNA, 3222 nt, synthetic construct
  misc_feature 1..3222: note = derived and/or modified CDS sequence (opt4) from SFTSV(HB2014-04)__KR080475.1__GP
  source 1..3222: mol_type = other RNA
atgatgaaggtgatctggttccccagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccacgtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaagcaagctggcctga

SEQ ID NO: 9862 - RNA, 3222 nt, synthetic construct
  misc_feature 1..3222: note = derived and/or modified CDS sequence (opt4) from SFTSV(HNXH)__KT254590.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccctgatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgaccggcgtgctgctgggcggcctggccctgttcttcctgatcatgagcctgttcaagctgggcaccaagcagatcttcagaagcagaaccaagctggcctga

SEQ ID NO: 9863 - RNA, 3222 nt, synthetic construct
  misc_feature 1..3222: note = derived and/or modified CDS sequence (opt4) from SFTSV(JS2012-goat01)__KC473538.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagcctggacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9864 - RNA, 3222 nt, synthetic construct
  misc_feature 1..3222: note = derived and/or modified CDS sequence (opt4) from SFTSV(JS2012-tick01)__KC473541.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9865 - RNA, 3222 nt, synthetic construct
  misc_feature 1..3222: note = derived and/or modified CDS sequence (opt4) from SFTSV(LN2012-14)__KF887436.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgtggatcgagatggccagacccagaagagtgagatactggatgtacagccccgtgatcctgaccatcctggccgtgggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggtgggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9866 - RNA, 3222 nt, synthetic construct
  misc_feature 1..3222: note = derived and/or modified CDS sequence (opt4) from SFTSV(LN2012-34)__KF887437.1__GP
  source 1..3222: mol_type = other RNA
atgatgaaggtgatctggttcttcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacgtgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcatcacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9867 - RNA, 3222 nt, synthetic construct
  misc_feature 1..3222: note = derived and/or modified CDS sequence (opt4) from SFTSV(LN2012-41)__KF887438.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacgtgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggtgaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9868 - RNA, 3222 nt, synthetic construct
  misc_feature 1..3222: note = derived and/or modified CDS sequence (opt4) from SFTSV(LN2012-58)__KF887440.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgtgcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggtgatgggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9869 - RNA, 3222 nt, synthetic construct
  misc_feature 1..3222: note = derived and/or modified CDS sequence (opt4) from SFTSV(NB24/CHN/2013)__KR698337.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcaacatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaagcaagctggcctga

SEQ ID NO: 9870 - RNA, 3222 nt, synthetic construct
  misc_feature 1..3222: note = derived and/or modified CDS sequence (opt4) from SFTSV(NB31/CHN/2013)__KR698338.1__GP
  source 1..3222: mol_type = other RNA
atgatgaaggtgatctggttcagcagcctgatctgcttcgtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccagcgagaacagcaacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagaacaccgagatccagttccacagcggcagcctggtgggcaagaccgtgatccacgtgaagggcgccctggtggacggcaccgagttcaccttcgagggcagctgcatgttccccgacggctgcgaggccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaacagagacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagtgctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtggtgggcgtgctgctgggcggcctggtgctgttcttcctgatcatgagcctgttcaagctgggcaccaagcaggtgttcagaagcagaaccaagctggcctga

SEQ ID NO: 9871 - RNA, 3222 nt, synthetic construct
  misc_feature 1..3222: note = derived and/or modified CDS sequence (opt4) from SFTSV(NB38/CHN/2013)__KR698341.1__GP
  source 1..3222: mol_type = other RNA
atgatgaaggtgatctggttcagcagcctgatctgcctggtgatccagtgcggcggcgacaccagccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacgaggaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatggaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaaccacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagcaaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggttcctgggcgtgatcggcgtgctgctgggcggcctggccctgttcttcctgatcatgagcctgttcaagctgggcaccaagcaggtgttcagaagcagaagcaagctggcctga

SEQ ID NO: 9872 - RNA, 3222 nt, synthetic construct
  misc_feature 1..3222: note = derived and/or modified CDS sequence (opt4) from SFTSV(NB39/CHN/2014)__KR698342.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggcagaagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacctgaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9873 - RNA, 3222 nt, synthetic construct
  misc_feature 1..3222: note = derived and/or modified CDS sequence (opt4) from SFTSV(QD7)__KR706566.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccatgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggccagctgcagacagggcagcggcaacatgaaggagtgcgtgaccaccggcagagccctgcaccccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9874 - RNA, 3222 nt, synthetic construct
  misc_feature 1..3222: note = derived and/or modified CDS sequence (opt4) from SFTSV(Rodent01/NB/CHN/2014)__KR698343.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggcagaagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacctgaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgatcggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9875 - RNA, 3222 nt, synthetic construct
  misc_feature 1..3222: note = derived and/or modified CDS sequence (opt4) from SFTSV(SDLZtick12/2010)__JQ684872.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9876 - RNA, 3222 nt, synthetic construct
  misc_feature 1..3222: note = derived and/or modified CDS sequence (opt4) from SFTSV(Zhao)__KF374684.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaaggtgagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9877 - RNA, 3222 nt, synthetic construct
  misc_feature 1..3222: note = derived and/or modified CDS sequence (opt4) from SFTSV(Zhejiang/01/2011)__KJ597824.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9878 - RNA, 3222 nt, synthetic construct
  misc_feature 1..3222: note = derived and/or modified CDS sequence (opt4) from SFTSV(ZJ2013-06)__KP280204.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcaacatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9879 - RNA, 3222 nt, synthetic construct
  misc_feature 1..3222: note = derived and/or modified CDS sequence (opt4) from SFTSV(ZJZHSH-AM/China/05/2012)__KR017846.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatccagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9880 - RNA, 3222 nt, synthetic construct
  misc_feature 1..3222: note = derived and/or modified CDS sequence (opt4) from SFTSV(ZJZHSH-CXD/China/05/2012)__KR017858.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacgtgtgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccagaacgacgtgagaatcgagatggccagacccagaagagtgagacactggatgtacagccccgtgatcctgaccatcctggccatcggcttcgccgagggctgcgacgagatggtgcacgccgacagcaagctggtgagctgcagacagggcagcgagaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9881 - RNA, 3222 nt, synthetic construct
  misc_feature 1..3222: note = derived and/or modified CDS sequence (opt4) from SFTSV(ZJZHSH-FDE/China/06/2012)__KR017859.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9882 - RNA, 3222 nt, synthetic construct
  misc_feature 1..3222: note = derived and/or modified CDS sequence (opt4) from SFTSV(ZJZHSH-FZHR/China/07/2013)__KR017862.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagagccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacgtgtgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9883 - RNA, 3222 nt, synthetic construct
  misc_feature 1..3222: note = derived and/or modified CDS sequence (opt4) from SFTSV(ZJZHSH-HCY/China/06/2012)__KR017855.1__GP
  source 1..3222: mol_type = other RNA
atgatgaaggtgatctggttccccagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgttcatgagcctgttcaagctgggcaccaagcaggtgttcagaagcagaaccaagctggcctga

SEQ ID NO: 9884 - RNA, 3222 nt, synthetic construct
  misc_feature 1..3222: note = derived and/or modified CDS sequence (opt4) from SFTSV(ZJZHSH-HYC/China/05/2012)__KR017847.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagaaagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9885 - RNA, 3222 nt, synthetic construct
  misc_feature 1..3222: note = derived and/or modified CDS sequence (opt4) from SFTSV(ZJZHSH-HYJ/China/07/2012)__KR017852.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaaggtgaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9886 - RNA, 3222 nt, synthetic construct
  misc_feature 1..3222: note = derived and/or modified CDS sequence (opt4) from SFTSV(ZJZHSH-LU/China/10/2011)__KR017850.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatgtgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9887 - RNA, 3222 nt, synthetic construct
  misc_feature 1..3222: note = derived and/or modified CDS sequence (opt4) from SFTSV(ZJZHSH-SHZ/China/05/2012)__KR017848.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacggctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9888 - RNA, 3222 nt, synthetic construct
  misc_feature 1..3222: note = derived and/or modified CDS sequence (opt4) from SFTSV(ZJZHSH-WSH/China/08/2012)__KR017854.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacgtgtgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcagaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaagcgtgagctgcctgatgggcaagctgatggacagaggcagacaggtgatccacgaggagatcggcgagaacagagagggcaaccaggacgacgtgagaatcgagatggtgagacccagaagagtgagacactggatgtacagccccgtgatcctgaccatcctggccatcggcctgaccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9889 - RNA, 3222 nt, synthetic construct
  misc_feature 1..3222: note = derived and/or modified CDS sequence (opt4) from SFTSV(ZJZHSH-XAM/China/06/2012)__KR017853.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9890 - RNA, 3222 nt, synthetic construct
  misc_feature 1..3222: note = derived and/or modified CDS sequence (opt4) from SFTSV(ZJZHSH-YJX/China/06/2012)__KR017860.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgacgccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccagttccacagcggcagcctggtgggcaagaccaccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcaggccagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgctggacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgaggtgaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgctgaccggcgccaacatccccagccccaccgactggctgaacgccctgttcggcaacggcctgagcaagtggatcctgggcgtgatcggcgtgctgctgggcggcctggccctgttcttcctgatcatgagcctgttcaagctgggcaccaagcagatcttcagaagcagaaccaagctggcctga

SEQ ID NO: 9891 - RNA, 3222 nt, synthetic construct
  misc_feature 1..3222: note = derived and/or modified CDS sequence (opt4) from SFTSV(SPL003A)__AB817988.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9892 - RNA, 3222 nt, synthetic construct
  misc_feature 1..3222: note = derived and/or modified CDS sequence (opt4) from SFTSV(SPL004A)__AB817989.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaaggaggacgagaccgccttcagcgtgctggagggcgtgcacagctacaccgtgagcctgagcttcgaccacgccgtggtggacgagcagtgccagctgaactgcggcggccacgagagccacgtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatgggcgtgctgctgggcggcctggccctgttcttcctgatcatgagcctgttcaagctgggcaccaagcaggtgttcagaagcagaaccaagctggcctga

SEQ ID NO: 9893 - RNA, 3222 nt, synthetic construct
  misc_feature 1..3222: note = derived and/or modified CDS sequence (opt4) from SFTSV(SPL005A)__AB817990.1__GP
  source 1..3222: mol_type = other RNA
atgatgaaggtgatctggttcagcagcctgatctgcctggtgatccagtgcagcggcgacgccagccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccctggacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccccctggagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcggcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9894 - RNA, 3222 nt, synthetic construct
  misc_feature 1..3222: note = derived and/or modified CDS sequence (opt4) from SFTSV(SPL010A)__AB817991.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccaccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9895 - RNA, 3222 nt, synthetic construct
  misc_feature 1..3222: note = derived and/or modified CDS sequence (opt4) from SFTSV(SPL030A)__AB817992.1__GP
  source 1..3222: mol_type = other RNA
atgatgaaggtgatctggttcagcagcctgatctgcctggtgatccagtgcagcggcgacaccagccccatcatctgcgccggccccatccacagcaacaagagcgccagcatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccctggacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagctgagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcggcggcaacatgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcaacagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9896 - RNA, 3222 nt, synthetic construct
  misc_feature 1..3222: note = derived and/or modified CDS sequence (opt4) from SFTSV(SPL053A)__AB985292.1__GP
  source 1..3222: mol_type = other RNA
atgatgaaggtgatctggttcagcagcctgatctgcctggtgatccagtgcagcggcgacaccggccccatcatctgcgccggccccatccacagcaacaagggcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcatcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9897 - RNA, 3222 nt, synthetic construct
  misc_feature 1..3222: note = derived and/or modified CDS sequence (opt4) from SFTSV(SPL054A)__AB985293.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcatggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacggcgagggcaaccaggacgacgtgagaatcgagatcgccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccagattcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9898 - RNA, 3222 nt, synthetic construct
  misc_feature 1..3222: note = derived and/or modified CDS sequence (opt4) from SFTSV(SPL055A)__AB985294.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgaggtggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9899 - RNA, 3222 nt, synthetic construct
  misc_feature 1..3222: note = derived and/or modified CDS sequence (opt4) from SFTSV(SPL057A)__AB985295.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcagaatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccatcagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9900 - RNA, 3222 nt, synthetic construct
  misc_feature 1..3222: note = derived and/or modified CDS sequence (opt4) from SFTSV(SPL062A)__AB985297.1__GP
  source 1..3222: mol_type = other RNA
atgatgaaggtgatctggttcagcagcctgatctgcctggtgatcagatgcagcggcggcaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccagaggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgccatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9901 - RNA, 3222 nt, synthetic construct
  misc_feature 1..3222: note = derived and/or modified CDS sequence (opt4) from SFTSV(SPL066A)__AB985298.1__GP
  source 1..3222: mol_type = other RNA
atgatgaaggtgatctggttcagcagcctgatctgcctggtgatccagtgcagcggcgacgccagccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatcagaagcgtgagctgcctgatgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccagatcttcaagggcgtgagcgtgacctacctgggcagcgacatggaggtgagcggcctgaccgacctgtgcgagatcgaggagctgagaagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9902 - RNA, 3222 nt, synthetic construct
  misc_feature 1..3222: note = derived and/or modified CDS sequence (opt4) from SFTSV(SPL070A)__AB985301.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcatggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagcccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctgatggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgaccggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagacccagaaccaagctggcctga

SEQ ID NO: 9903 - RNA, 3222 nt, synthetic construct
  misc_feature 1..3222: note = derived and/or modified CDS sequence (opt4) from SFTSV(SPL071A)__AB985302.1__GP
  source 1..3222: mol_type = other RNA
atgatgaaggtgatctggttcagcagcctgatctgcctgatcatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctggccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9904 - RNA, 3222 nt, synthetic construct
  misc_feature 1..3222: note = derived and/or modified CDS sequence (opt4) from SFTSV(SPL077A)__AB985304.1__GP
  source 1..3222: mol_type = other RNA
atgatgaaggtgatctggttcagcagcctgatctgcctggtgacccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcctgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcagcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagcagggcaccaagcaggtgttcagaagcagaaccaagctggcctga

SEQ ID NO: 9905 - RNA, 3222 nt, synthetic construct
  misc_feature 1..3222: note = derived and/or modified CDS sequence (opt4) from SFTSV(SPL084A)__AB985307.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacaccggcctgatgctgctgaccaacgtgctgaaggccatcggcgtgtggggcagctgggtgatcgcccccgtgaagctgatgttcgccatcctgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgcaggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9906 - RNA, 3222 nt, synthetic construct
  misc_feature 1..3222: note = derived and/or modified CDS sequence (opt4) from SFTSV(SPL086A)__AB985308.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9907 - RNA, 3222 nt, synthetic construct
  misc_feature 1..3222: note = derived and/or modified CDS sequence (opt4) from SFTSV(SPL087A)__AB985309.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaagcgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacacccagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagcccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaacagagacgacatcagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagagatgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9908 - RNA, 3222 nt, synthetic construct
  misc_feature 1..3222: note = derived and/or modified CDS sequence (opt4) from SFTSV(SPL090A)__AB985311.1__GP
  source 1..3222: mol_type = other RNA
atgatgaaggtgatctggttccccagcctgatctgcctggtgatcagatgcagcggcggcaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccagaggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgccatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9909 - RNA, 3222 nt, synthetic construct
  misc_feature 1..3222: note = derived and/or modified CDS sequence (opt4) from SFTSV(SPL097A)__AB985312.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaagcagggcaccggcccctgccccgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccaccagcggcaagaagaacaccgagatccagttccacagcggcagcctggtgggcaagaccgccatccacgtgaagggcgccctgctggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9910 - RNA, 3222 nt, synthetic construct
  misc_feature 1..3222: note = derived and/or modified CDS sequence (opt4) from SFTSV(SPL100A)__AB985313.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaagcagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcgtgaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctgctggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcgccgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccgtgctggccgtgggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcaacaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9911 - RNA, 3222 nt, synthetic construct
  misc_feature 1..3222: note = derived and/or modified CDS sequence (opt4) from SFTSV(SPL106A)__AB985316.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcctgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgaggtggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgatcggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcagcctgatcatgagcctgttcaagctgggcaccaagcaggtgctgagaagcagaaccaagctggcctga

SEQ ID NO: 9912 - RNA, 3222 nt, synthetic construct
  misc_feature 1..3222: note = derived and/or modified CDS sequence (opt4) from SFTSV(SPL117A)__AB985321.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacagaggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9913 - RNA, 3222 nt, synthetic construct
  misc_feature 1..3222: note = derived and/or modified CDS sequence (opt4) from SFTSV(SPL120A)__AB985322.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcctgaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgaggtggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcagcctgatcatgagcctgttcaagctgggcaccaagcaggtgttcagaagcagaaccaagctggcctga

SEQ ID NO: 9914 - RNA, 3222 nt, synthetic construct
  misc_feature 1..3222: note = derived and/or modified CDS sequence (opt4) from SFTSV(SPL121A)__AB985323.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagccccaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaaggtgaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatggaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9915 - RNA, 3222 nt, synthetic construct
  misc_feature 1..3222: note = derived and/or modified CDS sequence (opt4) from SFTSV(SPL124A)__AB985324.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatcagcctgttcaagctgggcaccaagcaggtgttcagaagcagaaccaagctggcctga

SEQ ID NO: 9916 - RNA, 3222 nt, synthetic construct
  misc_feature 1..3222: note = derived and/or modified CDS sequence (opt4) from SFTSV(SPL128A)__AB985325.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcagagtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccagagtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgccatcggcgtgctgctgggcggcctggccctgttcttcctgatcatcagcctgttcaagctgggcaccaagcaggtgttcagaagcagaaccaagctggcctga

SEQ ID NO: 9917 - RNA, 3222 nt, synthetic construct
  misc_feature 1..3222: note = derived and/or modified CDS sequence (opt4) from SFTSV(SPL129A)__AB985326.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcagcggcggcgtgagactgatcaccctgaccagcgagctgaagagcgccaccgtgtgcgccagccacttctgcagcagcgccaccagcggcaagaagagcaccgagatccagttccacagcggcagcctggtgggcaaggccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaagcgtgagctgcctgatgggcaagctgatggacagaggcagacaggtgatccacgaggagatcggcgagaacagagagggcaacagagacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggagaccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaaggaggacgagaccgccttcagcgtgctggagggcgtgcacagctacaccgtgagcctgagcttcgaccacgccgtggtggacgagcagtgccagctgaactgcggcggccacgagagccacgtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatgggcgtgctgctgggcggcctggccctgttcttcctgatcatgagcctgttcaagctgggcaccaagcaggtgttcagaagcagaaccaagctggcctga

SEQ ID NO: 9918 - RNA, 3222 nt, synthetic construct
  misc_feature 1..3222: note = derived and/or modified CDS sequence (opt4) from SFTSV(YG1)__AB817987.1__GP
  source 1..3222: mol_type = other RNA
atgatgaaggtgatctggttcagcagcctgatctgcctggtgatccagtgcagcggcgacaccggccccatcatctgcgccggccccatccacagcaacaagagcgccaacatcccccacctgctgggctacagcgagaagatctgccagatcgacagactgatccacgtgagcagctggctgagaaaccacagccagttccagggctacgtgggccagagaggcggcagaagccaggtgagctacttccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagagcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaagcgtgagctgcctgatgggcaagctgatggacagaggcagacaggtgatccacgaggagatcggcgagaacagagagggcaaccaggaggacgtgagaatcgagatggccagacccagaagagtgagacactggatgtacagccccgtgatcctggccatcctggccatcggcctggccgagggctgcgacgagatggtgcacgccgacagcaagctggtgagctgcaagcagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccagccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcagcgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9919 - RNA, 3222 nt, synthetic construct
  misc_feature 1..3222: note = derived and/or modified CDS sequence (opt4) from SFTSV(SDTA_1)__KX641913.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccagagagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagctgatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggagaccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatcgccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9920 - RNA, 3222 nt, synthetic construct
  misc_feature 1..3222: note = derived and/or modified CDS sequence (opt4) from SFTSV(SDTA_2)__KX641914.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcacatgatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9921 - RNA, 3222 nt, synthetic construct
  misc_feature 1..3222: note = derived and/or modified CDS sequence (opt4) from SFTSV(SDTA_3)__KX641915.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgaggtggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9922 - RNA, 3222 nt, synthetic construct
  misc_feature 1..3222: note = derived and/or modified CDS sequence (opt4) from SFTSV(SDTA_4)__KX641916.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatcttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatcttcgccatcatgaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcggcgccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9923 - RNA, 3222 nt, synthetic construct
  misc_feature 1..3222: note = derived and/or modified CDS sequence (opt4) from SFTSV(HBGS13_human_2015)__KY440773.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcatcgccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcatcatcatcatgagcctgttcaagctgggcaccaagcaggtgttcagaagcagaaccaagctggcctga

SEQ ID NO: 9924 - RNA, 3222 nt, synthetic construct
  misc_feature 1..3222: note = derived and/or modified CDS sequence (opt4) from SFTSV(HBMC16_human_2015)__KY440776.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaaggccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9925 - RNA, 3222 nt, synthetic construct
  misc_feature 1..3222: note = derived and/or modified CDS sequence (opt4) from SFTSV(HBMC5_human_2016)__KY440770.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgctgttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaaggccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9926 - RNA, 3222 nt, synthetic construct
  misc_feature 1..3222: note = derived and/or modified CDS sequence (opt4) from SFTSV(HB29)__KP202164.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatccacctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacaacaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9927 - RNA, 3222 nt, synthetic construct
  misc_feature 1..3222: note = derived and/or modified CDS sequence (opt4) from SFTSV(HNXY_115)__KC292312.1__GP
  source 1..3222: mol_type = other RNA
atgatgaaggtgatctggttcagcagcctgatctacttcgtgatccagtgcagcggcgacagcggcagcatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9928 - RNA, 3222 nt, synthetic construct
  misc_feature 1..3222: note = derived and/or modified CDS sequence (opt4) from SFTSV(HNXY_144)__KC292307.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9929 - RNA, 3222 nt, synthetic construct
  misc_feature 1..3222: note = derived and/or modified CDS sequence (opt4) from SFTSV(HNXY_157)__KC292305.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9930 - RNA, 3222 nt, synthetic construct
  misc_feature 1..3222: note = derived and/or modified CDS sequence (opt4) from SFTSV(HNXY_170)__KC292304.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccagatcaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatcggcgtgctgctgggcggcctggccctgttcttcatgatcatgagcctgttcaagctgggcaccaagcaggtgttcagaagcagaaccaagctggcctga

SEQ ID NO: 9931 - RNA, 3222 nt, synthetic construct
  misc_feature 1..3222: note = derived and/or modified CDS sequence (opt4) from SFTSV(HNXY_174)__KC292306.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcagaatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcatgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9932 - RNA, 3222 nt, synthetic construct
  misc_feature 1..3222: note = derived and/or modified CDS sequence (opt4) from SFTSV(HNXY_182)__KC292324.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgcagggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcctgatcggcgtgctgctgggcggcctggccctgttcttcatgatcatgagcctgttcaagctgggcaccaagcaggtgttcagaagcagaaccaagctggcctga

SEQ ID NO: 9933 - RNA, 3222 nt, synthetic construct
  misc_feature 1..3222: note = derived and/or modified CDS sequence (opt4) from SFTSV(HNXY_188)__KC292301.1__GP
  source 1..3222: mol_type = other RNA
atgatgaaggtgatctggttcagcagcctgatctgcctggtgatccagtgcggcggcggcaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9934 - RNA, 3222 nt, synthetic construct
  misc_feature 1..3222: note = derived and/or modified CDS sequence (opt4) from SFTSV(HNXY_191)__KC292323.1__GP
  source 1..3222: mol_type = other RNA
atgatgaaggtgatctggttcagcagcctgatctgcctggtgatccagtgcggcggcgacaccggccccatcatctgcgccggccccacccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9935 - RNA, 3222 nt, synthetic construct
  misc_feature 1..3222: note = derived and/or modified CDS sequence (opt4) from SFTSV(HNXY_195)__KC292326.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgcagggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9936 - RNA, 3222 nt, synthetic construct
  misc_feature 1..3222: note = derived and/or modified CDS sequence (opt4) from SFTSV(HNXY_2)__KC292318.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcatgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9937 - RNA, 3222 nt, synthetic construct
  misc_feature 1..3222: note = derived and/or modified CDS sequence (opt4) from SFTSV(HNXY_202)__KC292325.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagaagatcaacctgaagtgcaagagaagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9938 - RNA, 3222 nt, synthetic construct
  misc_feature 1..3222: note = derived and/or modified CDS sequence (opt4) from SFTSV(HNXY_206)__KC292302.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccaccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacatcagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccacccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9939 - RNA, 3222 nt, synthetic construct
  misc_feature 1..3222: note = derived and/or modified CDS sequence (opt4) from SFTSV(HNXY_207)__KC292315.1__GP
  source 1..3222: mol_type = other RNA
atgatgaaggtgatctggttccccagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9940 - RNA, 3222 nt, synthetic construct
  misc_feature 1..3222: note = derived and/or modified CDS sequence (opt4) from SFTSV(HNXY_224)__KC292317.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcgtggtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctgaccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgcgagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccagcccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9941 - RNA, 3222 nt, synthetic construct
  misc_feature 1..3222: note = derived and/or modified CDS sequence (opt4) from SFTSV(HNXY_231)__KC292313.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9942 - RNA, 3222 nt, synthetic construct
  misc_feature 1..3222: note = derived and/or modified CDS sequence (opt4) from SFTSV(HNXY_245)__KC292320.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccatcagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9943 - RNA, 3222 nt, synthetic construct
  misc_feature 1..3222: note = derived and/or modified CDS sequence (opt4) from SFTSV(HNXY_262)__KC292309.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagcagagtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgagaagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9944 - RNA, 3222 nt, synthetic construct
  misc_feature 1..3222: note = derived and/or modified CDS sequence (opt4) from SFTSV(HNXY_278)__KC292322.1__GP
  source 1..3222: mol_type = other RNA
atgatgaaggtgatctggttcagcagcctgatctgcctggtgatccagtgcggcggcgacaccggccccatcatctgcgccggccccacccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccggcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatgatccacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcacccccaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9945 - RNA, 3222 nt, synthetic construct
  misc_feature 1..3222: note = derived and/or modified CDS sequence (opt4) from SFTSV(HNXY_31)__KC292310.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9946 - RNA, 3222 nt, synthetic construct
  misc_feature 1..3222: note = derived and/or modified CDS sequence (opt4) from SFTSV/FTLSV(2011YGS5)__KF711925.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9947 - RNA, 3222 nt, synthetic construct
  misc_feature 1..3222: note = derived and/or modified CDS sequence (opt4) from SFTSV/FTLSV(2011YGS7)__KF711922.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttctaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9948 - RNA, 3222 nt, synthetic construct
  misc_feature 1..3222: note = derived and/or modified CDS sequence (opt4) from SFTSV/FTLSV(2011YPQ11)__KF711926.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagatacagatgcaccagcgtgagaagatgcccctgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcatgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9949 - RNA, 3222 nt, synthetic construct
  misc_feature 1..3222: note = derived and/or modified CDS sequence (opt4) from SFTSV/FTLSV(2011YPQ12)__KF711930.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgtggccagatacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9950 - RNA, 3222 nt, synthetic construct
  misc_feature 1..3222: note = derived and/or modified CDS sequence (opt4) from SFTSV/FTLSV(2011YPQ17)__KF711923.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccctggactgcaccttctgcagagagttcctgaagaacccccactgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9951 - RNA, 3222 nt, synthetic construct
  misc_feature 1..3222: note = derived and/or modified CDS sequence (opt4) from SFTSV/FTLSV(2011YSC22)__KF711927.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacgtgaagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgctgggcaacggcatgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9952 - RNA, 3222 nt, synthetic construct
  misc_feature 1..3222: note = derived and/or modified CDS sequence (opt4) from SFTSV/FTLSV(2011YSC60)__KF711945.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagtacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9953 - RNA, 3222 nt, synthetic construct
  misc_feature 1..3222: note = derived and/or modified CDS sequence (opt4) from SFTSV/FTLSV(2011YSH45)__KF711947.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctggagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcagaaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9954 - RNA, 3222 nt, synthetic construct
  misc_feature 1..3222: note = derived and/or modified CDS sequence (opt4) from SFTSV/FTLSV(2011YSH52)__KF711928.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcttcatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacaagaagtgcaagaagagcagcagctacttcgtgcccgacgccagatacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgagcgacctgtgcgagatcgaggagctgaacagcaagaagctggccctggccccctgcaaccaggccggcatgggcgtggtgggcaaggtgggcgagatccagtgcagcagcgaggagagcgccagaaccatcaagaaggacggctgcatcagaaacgccgacctggtgggcatcgaggtgagagtggacgacgccgtgttctacttcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcctgagcctgttcaagctgggcaccaagcagatcttcagaagcagaaccaagctggcctga

SEQ ID NO: 9955 - RNA, 3222 nt, synthetic construct
  misc_feature 1..3222: note = derived and/or modified CDS sequence (opt4) from SFTSV/FTLSV(2011YXX9)__KF711924.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgggagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9956 - RNA, 3222 nt, synthetic construct
  misc_feature 1..3222: note = derived and/or modified CDS sequence (opt4) from SFTSV/FTLSV(2012YGS10)__KF711937.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccgtgctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9957 - RNA, 3222 nt, synthetic construct
  misc_feature 1..3222: note = derived and/or modified CDS sequence (opt4) from SFTSV/FTLSV(2012YGS4)__KF711933.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcatccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9958 - RNA, 3222 nt, synthetic construct
  misc_feature 1..3222: note = derived and/or modified CDS sequence (opt4) from SFTSV/FTLSV(2012YSC6)__KF711931.1__GP
  source 1..3222: mol_type = other RNA
atgatgaaggtgatctggttcagcagcctgatctgcttcgtgatccagtgcagcggcggcagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccatcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9959 - RNA, 3222 nt, synthetic construct
  misc_feature 1..3222: note = derived and/or modified CDS sequence (opt4) from SFTSV/FTLSV(2012YSH10)__KF711940.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccatgagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9960 - RNA, 3222 nt, synthetic construct
  misc_feature 1..3222: note = derived and/or modified CDS sequence (opt4) from SFTSV/FTLSV(2012YSH104)__KF711943.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagaaagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgaccagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagatacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9961 - RNA, 3222 nt, synthetic construct
  misc_feature 1..3222: note = derived and/or modified CDS sequence (opt4) from SFTSV/FTLSV(2012YSH105)__KF711944.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcggcgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9962 - RNA, 3222 nt, synthetic construct
  misc_feature 1..3222: note = derived and/or modified CDS sequence (opt4) from SFTSV/FTLSV(2012YSH107)__KF711942.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagaccggcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagatacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9963 - RNA, 3222 nt, synthetic construct
  misc_feature 1..3222: note = derived and/or modified CDS sequence (opt4) from SFTSV/FTLSV(2012YSH14)__KF711938.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcatcggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9964 - RNA, 3222 nt, synthetic construct
  misc_feature 1..3222: note = derived and/or modified CDS sequence (opt4) from SFTSV/FTLSV(2012YSH16)__KF711934.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagatacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9965 - RNA, 3222 nt, synthetic construct
  misc_feature 1..3222: note = derived and/or modified CDS sequence (opt4) from SFTSV/FTLSV(2012YSH6)__KF711921.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggaacggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctggtgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9966 - RNA, 3222 nt, synthetic construct
  misc_feature 1..3222: note = derived and/or modified CDS sequence (opt4) from SFTSV/FTLSV(2012YSH86)__KF711939.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgccacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgctgagaagcagaaccaagctggcctga

SEQ ID NO: 9967 - RNA, 3222 nt, synthetic construct
  misc_feature 1..3222: note = derived and/or modified CDS sequence (opt4) from SFTSV/FTLSV(2012YSH89)__KF711935.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgaggccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9968 - RNA, 3222 nt, synthetic construct
  misc_feature 1..3222: note = derived and/or modified CDS sequence (opt4) from SFTSV/FTLSV(2012YSH9)__KF711919.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagcagagtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacagacccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagaacaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9969 - RNA, 3222 nt, synthetic construct
  misc_feature 1..3222: note = derived and/or modified CDS sequence (opt4) from SFTSV/FTLSV(2012YSH91)__KF711920.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccacgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgagaaggccagcgagaccaagtgcagatgcagcctggtgcacaagcccggcgaggtggtggtgagctacggcggcatgagagtgagacccaagtgctacggcatcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacatcaagtgcaagaagagcagcagctacttcgtgagagacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagaagcagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9970 - RNA, 3222 nt, synthetic construct
  misc_feature 1..3222: note = derived and/or modified CDS sequence (opt4) from SFTSV/FTLSV(2012YSH92)__KF711941.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagccacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgagaatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9971 - RNA, 3222 nt, synthetic construct
  misc_feature 1..3222: note = derived and/or modified CDS sequence (opt4) from SFTSV/FTLSV(2012YSH93)__KF711946.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcaacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgaccagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagatacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatgggtgctgggcgtgatgggcgtgctgctgggcggcctggccctgttcttcatgatcatgagcctgttcaagctgggcaccaagcaggtgttcagaagcagaaccaagctggcctga

SEQ ID NO: 9972 - RNA, 3222 nt, synthetic construct
  misc_feature 1..3222: note = derived and/or modified CDS sequence (opt4) from SFTSV/FTLSV(YGS1)__KF356537.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9973 - RNA, 3222 nt, synthetic construct
  misc_feature 1..3222: note = derived and/or modified CDS sequence (opt4) from SFTSV/FTLSV(YNY1)__KF356538.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgttcggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9974 - RNA, 3222 nt, synthetic construct
  misc_feature 1..3222: note = derived and/or modified CDS sequence (opt4) from SFTSV/FTLSV(YPQ133)__KF356530.1__GP
  source 1..3222: mol_type = other RNA
atgatgaaggtgatctggttcagcagcctgatctgcttcgtgatccagtgcagcggcgacagcagccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccagaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcgtgatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9975 - RNA, 3222 nt, synthetic construct
  misc_feature 1..3222: note = derived and/or modified CDS sequence (opt4) from SFTSV/FTLSV(YPQ2)__KF356531.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagatcgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccatggccagattcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccaggtgaagatcagcggcagccccctggacatcaccgccatgagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9976 - RNA, 3222 nt, synthetic construct
  misc_feature 1..3222: note = derived and/or modified CDS sequence (opt4) from SFTSV/FTLSV(YPQ5)__KF356532.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagcagagtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgtggccagatacagatgcaccagcgtgagaagatgcagatgggccggcgactgccagagcggctgccccccccacttcaccagcaacagcttcagcaacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagctacatggaggtgagcggcctgaccgacctgtgcgagatcgaggagctgagaagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatgggcgtgctgctgggcggcctggccctgttcttcatgatcatgagcctgttcaagctgggcaccaagcaggtgttcagaagcagaaccaagctggcctga

SEQ ID NO: 9977 - RNA, 3222 nt, synthetic construct
  misc_feature 1..3222: note = derived and/or modified CDS sequence (opt4) from SFTSV/FTLSV(YSC19)__KF356536.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccatggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatgaagaagctgatgagaaccgtgagctgcctggtgggcaagctgatggacagaggcagacaggtgatccacgaggagatcggcgagaacggcgagggcaaccacgacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccagcgtgaaccccggccaggaggcctgcctgcacttcaccgcccccggcagccccgacagcaagtgcctgaagatcaaggtgaagagaatcaacctgaagtgcaagaagagcagcagctacttcgtgcccatcgccagaaacagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacagccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcaggtgttcagaagcagaaccaagctggcctga

SEQ ID NO: 9978 - RNA, 3222 nt, synthetic construct
  misc_feature 1..3222: note = derived and/or modified CDS sequence (opt4) from SFTSV/FTLSV(YSC3)__KF356535.1__GP
  source 1..3222: mol_type = other RNA
atgatgaaggtgatctggttcagcagcctggtgtgcctggtgatccagtgcagcggcgacagcggccccatcatctgcgccggccccatccacagcaacaagagcgccgccatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagaatcagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagctacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9979 - RNA, 3222 nt, synthetic construct
  misc_feature 1..3222: note = derived and/or modified CDS sequence (opt4) from SFTSV/FTLSV(YSH39)__KF356529.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcatggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggccacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9980 - RNA, 3222 nt, synthetic construct
  misc_feature 1..3222: note = derived and/or modified CDS sequence (opt4) from SFTSV/FTLSV(YSHX002)__KF356540.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggaacggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctggtgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagaagcagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9981 - RNA, 3222 nt, synthetic construct
  misc_feature 1..3222: note = derived and/or modified CDS sequence (opt4) from SFTSV/FTLSV(YXX2)__KF356534.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgactacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9982 - RNA, 3222 nt, synthetic construct
  misc_feature 1..3222: note = derived and/or modified CDS sequence (opt4) from SFTSV/Huaiyangshan virus(2010-FQM)__HQ419236.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaaggccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgttcaagctgggcaccaagcagatcttcagaagcagaaccaagctggcctga

SEQ ID NO: 9983 - RNA, 3222 nt, synthetic construct
  misc_feature 1..3222: note = derived and/or modified CDS sequence (opt4) from SFTSV/Huaiyangshan virus(2010-LZR)__HQ419237.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctggatccccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9984 - RNA, 3222 nt, synthetic construct
  misc_feature 1..3222: note = derived and/or modified CDS sequence (opt4) from SFTSV/Huaiyangshan virus(2010-T112)__HQ419238.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgtgcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacgcccccgtgatcctgaccatcctggccatgggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgtggcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9985 - RNA, 3222 nt, synthetic construct
  misc_feature 1..3222: note = derived and/or modified CDS sequence (opt4) from SFTSV/Huaiyangshan virus(2010-WJ)__HQ419229.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggcaagagaggcggcagaagccaggtgagctactacctggccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcacccccaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9986 - RNA, 3222 nt, synthetic construct
  misc_feature 1..3222: note = derived and/or modified CDS sequence (opt4) from SFTSV/Huaiyangshan virus(2010-WJQ)__HQ419230.1__GP
  source 1..3222: mol_type = other RNA
atgatgaaggtgatctggttcagcagcctgatctgcctggtgatccagtgcggcggcgacaccggccccatcatctgcgccggccccacccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcggctgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9987 - RNA, 3222 nt, synthetic construct
  misc_feature 1..3222: note = derived and/or modified CDS sequence (opt4) from SFTSV/Huaiyangshan virus(2010-WSQ)__HQ419235.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagagagcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctgatcggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgaggactgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagaagagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9988 - RNA, 3222 nt, synthetic construct
  misc_feature 1..3222: note = derived and/or modified CDS sequence (opt4) from SFTSV/Huaiyangshan virus(2010-WWG)__HQ419231.1__GP
  source 1..3222: mol_type = other RNA
atgatgaaggtgatctggttcagcaccctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttccccagaatgatggccaccctggaggtgaaccagcccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgctgatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagagccgtgagctgcctgatgggcaagctgatggacagaggcagacaggtgatccacgagggcatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9989 - RNA, 3222 nt, synthetic construct
  misc_feature 1..3222: note = derived and/or modified CDS sequence (opt4) from SFTSV/Huaiyangshan virus(2010-WWX)__HQ419232.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgcctgctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctgatcgacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9990 - RNA, 3222 nt, synthetic construct
  misc_feature 1..3222: note = derived and/or modified CDS sequence (opt4) from SFTSV/Huaiyangshan virus(2010-ZGQ)__HQ419233.1__GP
  source 1..3222: mol_type = other RNA
atgatgaaggtgatctggttcagcagcctgatctgcctggtgatccagtgcggcggcgacaccggccccatcatctgcgccggccccacccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgagccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcgtggtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcagatcttcagaagcagaaccaagctggcctga

SEQ ID NO: 9991 - RNA, 3222 nt, synthetic construct
  misc_feature 1..3222: note = derived and/or modified CDS sequence (opt4) from SFTSV/Huaiyangshan virus(M-HZM)__JF951393.1__GP
  source 1..3222: mol_type = other RNA
atgatgaaggtgatctggttcagcagcctgacctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagaacaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaacctgagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9992 - RNA, 3222 nt, synthetic construct
  misc_feature 1..3222: note = derived and/or modified CDS sequence (opt4) from SFTSV/Phlebovirus(AH15/China/2010 strain AH15)__HQ141593.1__GP
  source 1..3222: mol_type = other RNA
atgatgaaggtgatctggttcttcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatgggcgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacgagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatgggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcatcaactacagaggcctgagactgagcctgaccgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9993 - RNA, 3222 nt, synthetic construct
  misc_feature 1..3222: note = derived and/or modified CDS sequence (opt4) from SFTSV/Phlebovirus(HN6/China/2010 strain HN6)__HQ141596.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctggtgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgagatgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaccgtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9994 - RNA, 3222 nt, synthetic construct
  misc_feature 1..3222: note = derived and/or modified CDS sequence (opt4) from SFTSV/Phlebovirus(JN1/China/2010)__JN258706.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccaacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactggtgaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctgaagggcgtgcacagctacatcgtgagcctgagcttcgaccacgccgtggtggacgagcagtgccagctgaactgcggcggccacgagagccaggtgaccctgaagggcaacctgatcttcctggacgtgcccatcttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 9995 - RNA, 3222 nt, synthetic construct
  misc_feature 1..3222: note = derived and/or modified CDS sequence (opt4) from SFTSV/Phlebovirus(JS2010-014)__JQ317170.1__GP
  source 1..3222: mol_type = other RNA
atgatgaaggtgatctggttcagctacctgatctgcttcgtgatccagtgcagcggcgacagcggccccatcatctgggccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagaatcagacccaagtgctacggcttcagcagaatgatggccaccctggaggtgagccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagtgggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9996 - RNA, 3222 nt, synthetic construct
  misc_feature 1..3222: note = derived and/or modified CDS sequence (opt4) from SFTSV/Phlebovirus(JS2010-015)__JQ317173.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9997 - RNA, 3222 nt, synthetic construct
  misc_feature 1..3222: note = derived and/or modified CDS sequence (opt4) from SFTSV/Phlebovirus(JS2010-019)__JQ317179.1__GP
  source 1..3222: mol_type = other RNA
atgatgaaggtgatctggttcagcagcctgacctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagactgggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgagaaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagagctgcgacgagatggtgcacgccgacagcaagctggtgagctgcagacagggcagcggcaacatgaaggagtgcgtgaccaccggcagagccctgctgagcgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcggccacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 9998 - RNA, 3222 nt, synthetic construct
  misc_feature 1..3222: note = derived and/or modified CDS sequence (opt4) from SFTSV/Phlebovirus(JS24)__HQ830164.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcggcggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagaagatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 9999 - RNA, 3222 nt, synthetic construct
  misc_feature 1..3222: note = derived and/or modified CDS sequence (opt4) from SFTSV/Phlebovirus(JS4/China/2010 strain JS4)__HQ141605.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgctgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcgagaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 10000 - RNA, 3222 nt, synthetic construct
  misc_feature 1..3222: note = derived and/or modified CDS sequence (opt4) from SFTSV/Phlebovirus(JS6)__HQ830170.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacgagcccgagcagagaatcggccagtgcaccggctgccagctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatgggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcatcaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccaggtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 10001 - RNA, 3222 nt, synthetic construct
  misc_feature 1..3222: note = derived and/or modified CDS sequence (opt4) from SFTSV/Phlebovirus(JSD1)__JF267784.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagccacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcaacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccttcctggccatcggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 10002 - RNA, 3222 nt, synthetic construct
  misc_feature 1..3222: note = derived and/or modified CDS sequence (opt4) from SFTSV/Phlebovirus(LN2/China/2010 strain LN2)__HQ141608.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcagaatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgtgcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcatctggggcagctgggtgatcgcccccgtgaagctgatcttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacgcccccgtgatcctgaccatcctggccatgggcctggccgagagctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcatgatcatgagcctgttcaagctgggcaccaagcaggtgttcagaagcagaaccaagctggcctga

SEQ ID NO: 10003 - RNA, 3222 nt, synthetic construct
  misc_feature 1..3222: note = derived and/or modified CDS sequence (opt4) from SFTSV/Phlebovirus(LN3/China/2010 strain LN3)__HQ141611.1__GP
  source 1..3222: mol_type = other RNA
atgatgaaggtgatctggttcagcagcctgatctgcctggtgatccagtgcggcggcgacaccggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaaccagcccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctggtgttcgccatcatcaagaagctgatgagagccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccatcggcctggccgagggctgcgacgagatggtgcacgccgacagcagactggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacagcgtgagcctgagcttcgaccacgccgtggtggacgagcagtgccagctgaactgcggcggccacgagagccacgtgaccctgagaggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 10004 - RNA, 3222 nt, synthetic construct
  misc_feature 1..3222: note = derived and/or modified CDS sequence (opt4) from SFTSV/Phlebovirus(SD24/China/2010 strain SD24)__HM802201.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacatcgcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 10005 - RNA, 3222 nt, synthetic construct
  misc_feature 1..3222: note = derived and/or modified CDS sequence (opt4) from SFTSV/Phlebovirus(SD4/China/2010 strain SD4)__HM802203.1__GP
  source 1..3222: mol_type = other RNA
atgatgaaggtgatctggttcagcagcctgatctgcttcgtgatccagtgcagcggcgacagcggccccatcatctgcgccggccccatccacagcaacaagagcgccgacatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaagggcagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaagacctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgaagagcgccaccgtgtgcgccagccacttctgcagcagcgccaccagcggcaagaagagcaccgagatccagttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgctgttcgccatcatcaagaagctgatgagaaccgtgagctgcctgatgggcaagctgatggacagaggcagacaggtgatccacgaggagatcggcgagaacagagagggcaaccaggacgacgtgagaatcgagatggccagacccagaagagtgagacactggatgtacagccccgtgatcctgaccatcctggccaccggcctggccgagggctgcgacgagatggtgcacgccgacagcaagctggtgagctgcagacagggcagcggcaacatgaaggagtgcgtgaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccacctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtgatcggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacaccgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgagcctgttcaagctgggcaccaagcaggtgttcagaagcagaaccaagctggcctga

SEQ ID NO: 10006 - RNA, 3222 nt, synthetic construct
  misc_feature 1..3222: note = derived and/or modified CDS sequence (opt4) from SFTSV/Phlebovirus(SDYY104/China/2011)__KU239112.1__GP
  source 1..3222: mol_type = other RNA
atgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaacagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcatgagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccaccagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagcctgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcgtgttcctgctgaagctgggcaccaagcaggccttcagaagcagaaccaagctggcctga

SEQ ID NO: 10007 - RNA, 3417 nt, synthetic construct
  misc_feature 1..3417: note = derived and/or modified CDS sequence (opt3) from ANDV(Chile-9717869)__AF291703.2__GP
  source 1..3417: mol_type = other RNA
atggagggctggtacctggtggtcctcggggtttgctatacccttacactggccatgcccaagactatctacgaattgaaaatggagtgtcctcacacggtgggattaggtcagggctatattatagggagcaccgaactgggactaatctccattgaggctgcatctgacatcaagctcgaatcaagttgcaacttcgatctgcatacaactagcatggcccaaaaatcctttacccaggtagagtggagaaagaaatctgacacaaccgatactacaaatgcggcttcgaccacgttcgaggcccagactaagaccgtgaaccttaggggcacatgtattctggcaccagaattgtacgacactctcaagaaagtcaagaaaaccgtgctgtgctatgatctgacatgtaatcagacccactgccaaccgacggtttacctcatcgcccccgtgttaacttgtatgtcaatacggagctgcatggctagtgtctttacatcccgcatccaggtgatttatgagaagacccattgtgtaactggtcagctgatcgaagggcagtgcttcaaccctgcacacacacttaccttgtctcaaccagcccatacgtacgacaccgttacactgcccattagctgtttcttcactcctaaaaagtccgagcagctaaaggtgatcaaaacctttgagggaatactcacaaagactggctgcaccgaaaatgctctgcagggctactatgtctgcttccttgggtcacacagtgagccactgattgtgcccagcttggaagatatccgatctgccgaggtggtctcccgtatgctcgttcaccctagaggagaagaccatgatgcgattcagaactcacaaagccacctgaggatcgtgggtccaatcacagcaaaagtaccgagtacctcttccactgacacgttaaagggcacagcctttgctggggtgcccatgtacagctcgctgtctaccctcgtccggaatgccgatcctgagttcgtgttttccccaggaattgttcccgagtcaaaccatagtacttgtgacaaaaagaccgtgcctataacatggaccggctatcttccaatcagcggtgaaatggagaaagtcactgggtgcacagtgttctgtacgctggcaggacccggcgcttcctgcgaagcctactctgagaatggcatttttaacatcagctcaccgacctgtttggtaaataaggttcagcgcttcagagggagtgaacagaagataaacttcatttgccaaagggtggatcaggacgtcgtggtctattgtaatggacagaaaaaggtgatcctaactaaaacactggttatcggtcagtgcatttacacctttacatccctcttcagcctgatgcctgacgtggcgcactctcttgccgtagagctgtgtgtccccggcttgcacgggtgggcaactgtgatgctcctgtcaaccttttgcttcggatgggttttaatcccagctgtgacgctgattatactaaagtgtctccgggtcctgacctttagttgcagccattatacaaacgagtccaaattcaagtttatccttgaaaaggtgaaaattgagtaccaaaagactatgggctctatggtatgcgatgtgtgtcaccatgaatgcgagaccgccaaagaattggagtcgcaccgccagagctgtatcaatggtcagtgcccttactgtatgacaatcactgaggctaccgaatccgccctgcaggcacattattcaatttgcaagctcacggggcgattccaagaggccctgaaaaagagtcttaagaaacccgaagttaagaaaggctgttacagaacactgggagtctttaggtataagtctcggtgctacgtgggcttggtgtggtgtctcctgttaacctgcgagatagtcatctgggctgcgagcgcagagactccactgatggaatccgggtggtcagacacagcccacggagttggtgagattcccatgaaaaccgatctagaactcgacttcagcctgccttcttccagtagctattcttaccgtcgcaagctcactaacccagctaacaaggaggaatccatcccgtttcacttccagatggagaaacaggtgattcatgccgagatccagcccttgggccactggatggatgcaacctttaatataaagacagccttccattgttatggggcttgccaaaaatactcatacccttggcagacgagtaagtgcttctttgaaaaagactatcagtacgagaccggatggggctgtaacccaggtgattgccccggggtgggcactggatgtacagcctgcggcgtatatctggacaagctcaaaagcgtcgggaaggcatacaagatcatttcgctgaaatataccagaaaggtgtgtatccagttaggaacagaacaaacttgcaaacacattgatgcgaatgactgtctggttaccccttccgtgaaggtctgcatcgtgggtacggtttctaaacttcagccaagcgatacattgctctttctgggccccctagagcaagggggaataattctgaagcagtggtgtaccacttcatgcgcttttggcgacccgggtgacatcatgagtaccccttccgggatgaggtgtccagaacacacaggctctttccggaagatttgcggatttgccactacccccgtgtgcgagtaccagggcaacacaatcagcgggtataaacgaatgatggcaacgaaggattccttccagtcatttaatctcaccgagcctcatataactacaaacaaactggaatggatcgaccccgatggaaatacccgcgaccacgtaaaccttgtcttgaatagagatgtgagcttccaggacctgagtgataacccatgtaaggtggacttacatactcaagccattgagggcgcttggggttctggggtcggatttacacttacctgcacggttggcctgactgaatgtccttccttcatgaccagcatcaaagcctgcgatcttgcaatgtgttacggttcgacagtgaccaatctggctaggggctcaaacactgtaaaggtggtcgggaagggaggccactctgggagttcctttaaatgctgtcatgacacagattgcagctctgagggattgctcgccagcgcgccccacctggaacgggtgaccggcttcaatcagattgactccgataaggtttacgacgacggtgccccaccgtgtacatttaaatgctggttcactaagtcaggggagtggctactgggaatcctcaacggcaattggatagtggtcgtggttctggtggtcattcttatcttgagtatcattatgttcagcgtactgtgtcctcgcagaggtcacaaaaagaccgtgtga

SEQ ID NO: 10008 - RNA, 3417 nt, synthetic construct
  misc_feature 1..3417: note = derived and/or modified CDS sequence (opt3) from ANDV(AH-1)__AF324901.2__GP
  source 1..3417: mol_type = other RNA
atggagggctggtacctggtggccctcggggtctgctatacccttacactggctatgcccaagactatctacgaattgaaaatggagtgtcctcacacggttggattaggtcagggctatattatagggagcaccgaactgggactaatctccattgaggcagcctctgacatcaagctcgaatcaagttgcaacttcgatctgcatacaactagcatggcgcaaaaatcctttacccaggtggagtggagaaagaaatctgacacaaccgatactacaaatgctgcctcgaccacgttcgaggcacagactaagaccgtaaaccttaggggcacatgtattctggccccagaattgtacgacactctcaagaaagtgaagaaaaccgtcctgtgctatgatctgacatgtaatcagacccactgccaaccgacggtgtacctcatcgctcccgttttaacttgtatgtcaatacggagctgcatggcaagtgtgtttacatcccgcatccaggtcatttatgagaagacccattgtgtgactggtcagctgatcgaagggcagtgcttcaaccctgcccacacacttaccttgtctcaaccagctcatacgtacgacaccgtaacactgcccattagctgctttttcactcctaaaaagtccgagcagctaaaggttatcaaaacctttgagggaatactcacaaagactggctgtaccgaaaatgccctgcagggctactatgtgtgcttccttgggtcacacagtgagccactgattgtccccagcttggaagatatccgatctgcggaggtggtgtcccgtatgctcgtccaccctattggagaagaccatgatgcaatccagaactcacaaagctacctgagaatcgttggtccaattacagccaaagtgccgagtacctcttccactgacacgttaaagggcatagcttttgccggggtacccatgtatagctcgttctctacactggtgaggaatgcagatcctgagtttgtcttctccccaggaatcattcccgagtcaaaccacagtgtgtgtgacaaaaagaccgttcctatcacttggaccggctacctcccaataagcggtgaaatggagaaagtgacagggtgcaccgtcttttgtactcttgctggacccggcgcctcctgcgaagcgtattctgagaatggcattttcaacatcagctcaccgacatgtctggtgaataaggtacagcggttccgcgggagtgaacagaagatcaactttatttgccaaagagttgatcaggacgtggtcgtgtactgtaatggacagaaaaaggtcatcttgacgaaaaccctagtgattggtcagtgcatatatactttcacatccctgtttagcctcatgcctgacgttgcccattctctggcagtggagctttgtgtacccggcctgcacgggtgggctaccgtcatgttgctctcaacattctgctttggatgggtgctgatcccagccgttactttaattatcctgaagtgtctaagggtgctcaccttcagttgcagccactacacgaacgagtccaaatttaagttcatcctggaaaaggtcaaagtggagtaccaaaagaccatgggctctatggtatgcgatgtgtgtcatcacgaatgcgagacagctaaagaacttgagtcgcatcggcagagctgtattaatggtcagtgcccttattgtatgactataaccgaggccacagaatccgcattgcaggcccactactcaatctgcaagctgactgggcgctttcaagaggctctcaaaaagagtctgaagaaacccgaagttaagaaaggctgttatcgaacccttggagtcttcagatacaagtctaggtgctatgtgggcctggtgtggtgtttgctcctgacgtgcgagattgtcatctgggcggcaagcgccgagacaccattaatggaatccgggtggtcagacaccgctcatggagttggtgagattcccatgaaaactgatctggaactagactttagcctcccttcttccagtagctactcttatcggcgtaagctgacaaacccagccaacaaggaggaatccatcccgttccactttcagatggagaaacaggtgatacacgcagagatccagccccttggccattggatggatgccaccttcaatattaagactgctttccactgttacggggcctgccaaaaatactcatatccttggcagaccagtaagtgctttttcgaaaaagactaccagtatgagacaggatggggctgtaacccaggtgattgccccggggtgggcacgggatgtaccgcatgcggcgtatacttggacaagctgaaaagcgtcgggaaggcgtataagatcatttcgctcaaatacactcgcaaggtgtgtatccagctgggaacagaacaaacctgcaaacatatagatgctaatgactgtttagttacaccttccgtgaaggtctgcattgtgggtactgtttctaaactgcagccaagcgatacccttttgtttctcggccccctggagcaagggggaatcattctaaagcagtggtgtacgacatcatgcgccttcggcgacccgggtgacatcatgagtaccccttccgggatgagatgtccagaacacactggctcttttaggaagatatgcggattcgcaaccacacccgtgtgcgagtatcagggcaacactgtaagcgggtacaaacggatgatggccaccaaggattcctttcagtcattcaatctgacagagcctcacatcacgaccaacaaactcgaatggattgaccccgatggaaatactcgagaccatgtcaacctggtgcttaatcgcgatgtgagctttcaggacttgagtgataacccatgtaaggtcgacctgcacacacaagctatcgagggcgcctggggttctggggttggattcaccttaacttgcacagtgggcctcaccgaatgtccttcctttatgacgagcattaaagcatgcgatctggctatgtgttacggttcgactgtagccaatcttgcgagaggctcaaacaccgtgaaggtcgtggggaagggaggccattctgggagttccttcaaatgctgtcacgacacagattgcagctctgagggactgttggccagcgctccccatctcgaaagggttaccggctttaatcagatcgactccgataaggtgtatgacgacggtgcaccaccgtgtactttcaaatgctggttcacaaagtcaggggagtggctgctaggaatactgaacggcaattggattgtcgtggttgtgctcgtcgtaatcctgatccttagtattatcatgtttagcgtgttgtgtcctcggcgcggtcacaaaaagaccgtttga

SEQ ID NO: 10009 - RNA, 3417 nt, synthetic construct
  misc_feature 1..3417: note = derived and/or modified CDS sequence (opt3) from ANDV(CHI-7913)__AY228238.1__GP
  source 1..3417: mol_type = other RNA
atggagggctggtacctggtggccctcgggatctgctatacccttacactggccatgcccaagactacgtacgaattgaaaatggagtgtcctcacaccgtcggattaggtcagggctatattatagggagcacagaactgggactaatctccattgaggcagcctctgacatcaagctcgaatcaagttgcaacttcgatctgcatactaccagcatggcgcaaaaatcctttacacaggttgagtggagaaagaaatctgacaccactgatacaaccaatgctgcctcgacgactttcgaggcacagaccaagacagtgaaccttaggggcacttgtattctggccccagaattgtacgacaccctcaagaaagtaaagaaaacagtgctgtgctatgatctgacctgtaatcagacgcactgccaaccgactgtctacctcatcgctcccgtgttaacatgtatgtcaatacggagctgcatggcacgcgtttttaccagtcgaatccaggtgatttatgagaagactcattgtgtcacaggtcagctgatcgaagggcagtgcttcaaccctgcccacacccttacgttgtcccaaccagctcatacctacgacacagtgactctgcccatttcttgctttttcacccctaaagagagcgagcagctaaaggtaatcaagacatttgaaggaatactcactaaaaccggctgtacagagaatgccctgcagggctactatgtttgcttccttgggtcccactcagaaccactgattgtgcccagtttggaggatatccgtagcgcggaagtcgtgtctagaatgctcgtgcaccctaggggagaggaccatgatgcaattcagaactcccaatcacatctgcggatcgtcggtccaatcaccgccaaggttccgagcactagctctacggacacattaaaaggcaccgcttttgccggggtgcccatgtactccagcctgtcgactctcgtaaagaatgcagatcctgagttcgtgttttctccaggaattatacccgaatccaaccactcagtctgtgacaaaaagaccgtgcctatcacatggaccggctatcttccaattagtggtgagatggaaaaagttactgggtgcacagtgttctgtacgctggctggacccggcgccagctgcgaggcgtactccgaaaatggcatctttaacatatctagcccgacctgtttggtcaataaggtgcagcgcttcagagggtcagagcagaagattaacttcatctgccaaagggtagatcaggacgttgtggtctattgtaatggacagaaaaaggtgatcctaactaaaacactggtcattggtcagtgcatctacacctttacaagtctcttctccctgatgcctgacgtggcccacagccttgcagttgagctgtgtgtgcccggcttgcacgggtgggctactgtaatgctcctgtctaccttttgcttcggatgggtcttaattccagccgtgacgctgataatcctaaagtgtctccgggttctgaccttttcatgcagtcattatacaaacgaaagcaaattcaagtttattcttgagaaggtgaaagtcgaataccaaaagactatgggctccatggtgtgcgatgtatgtcaccatgagtgcgaaaccgctaaagagttggagtctcaccgccagtcgtgtatcaatggtcagtgcccttactgtatgacaatcactgaagccaccgagagcgcactgcaggcccattattccatttgcaagctcacggggcgattccaagaagctctgaaaaagtcacttaagaaacccgaggtgaagaaaggctgttacagaacactgggagtttttaggtataagagtcggtgctacgtcggcttggtgtggtgtctcctgttaacctgcgagatagtgatctgggcggcatctgccgaaactccactgatggagagcgggtggtccgacacagctcacggagtcggtgaaattcccatgaaaaccgatctagagctcgacttctcactgcctagttcttccagttatagctaccgtcgcaaacttactaacccagccaacaaggaagagtctatctcctttcacttccagatggagaaacaggttattcatgcagaaatccagccgttgggccactggatggatgccacctttaatacaaagacggctttccattgttatggggcctgccaaaaatactcatacccctggcagaccagtaagtgcttctttgagaaagactatcagtacgaaactggatggggctgtaaccctggtgattgcccaggggtgggcacaggatgtaccgcatgcggcgtgtatctggacaagctcaaaagcgtagggaaggcgtacaagataatctcgctgaaatatacaagaaaggtctgtattcagttaggaactgagcaaacctgcaaacacatcgatgctaatgactgtctggtgacgccctccgttaaggtgtgcattgtcggtacagtgtctaaacttcagcctagcgataccctcctcttcctgggcccactagaacaagggggagttatcctgaagcagtggtgtactacctcatgcgcctttggcgaccccggtgacataatgagtacaccgtccgggatgaggtgtcctgagcacactggctctttccggaagatttgcggatttgcaaccacaccagtgtgcgagtaccagggcaacacgatcagcgggtataaacgaatgatggccaccaaggattccttccagtcatttaatctcactgaaccccatattacagctaacaaactggagtggatcgaccctgatggaaatacccgcgaccacgtaaaccttgtcttgaatagagatgtgagcttccaggacctgagtgataacccctgtaaggtggacttacatactcaagccatagaaggcgcatggggttctggggtcggatttacattgacctgcacggttggcctgactgagtgtccatccttcatgaccagcatcaaggcttgcgatcttgccatgtgttacggttcgacagtggcgaatctggccaggggctcaaacaccgtaaaggtggtcgggaagggaggccactctgggagttcctttaaatgctgtcatgacactgattgcagctctgaaggattgctcgctagcgcacctcacctggagcgggtgacaggcttcaatcagattgactccgataaggtttacgacgacggtgctcccccatgtacctttaaatgctggttcacaaagtcaggggagtggctactgggaatcctcaacggcaattggattgtggtcgtggttctggtggtcatccttatattgagtattatcatgttcagcgtactgtgtccgcgcagaggtcacaaaaagactgtgtga

SEQ ID NO: 10010 - RNA, 3417 nt, synthetic construct
  misc_feature 1..3417: note = derived and/or modified CDS sequence (opt3) from Hu39694(Hu39694)__AF028023.1__GP
  source 1..3417: mol_type = other RNA
atggagggctggtacctgatcgtgctcggggtctgcagcacccttacactggccatgcccagaactatttatgaattgaggatggagtgtcctcacacggttggattaggtcagggctacataatcgggtccaccgaactgggactaattccaatcgagacagtgtctgacctcaagctggaatcaagttgcaacttcgatcttcatactaccagcatgacacaaaaatcctatacccaggtagagtggcggaagaaatctgacactacagataccacgaatgctgcatcgactacctttgaggcccagacaaagactgtgaacctgcgcggcacctgtgtcttggcgtcagaactctacgacacactgaaaaagattaagaaaaccgtgctgtgctatgatctcacgtgtaatcagactcactgccaaccgacagtttacttaatcgctcccgtgagcacctgtatgagtatacgatcctgcatggcctctgtcttcactaaccgtatccaggtgatttatgagaagacacattgtgtaaccggtcagctggttgaagggcagtgctttaatcctgcacacacgcttaccttgagccaaccagcccatacatacgagatggtgactctgcccgtcacctgtttctttacacctaaaaagtccgaccagctaaaactcatcaagactttcgagggaattatctcaaagaccggctgcacagaaaacgctctgcagggctactatgtgtgctttcttgggagtcacagcgagccactgcacgtgccctctttggaagatataagatccgtcgaggttttctcaaggatgattatccatcctcggggagaagaccacgatccaattcagaatagccaaggttttctccgcatcgtgggcccgatcaccgcaaaagtacccagtacttcttccacggacacactgaaggggaccgccttcgctggagtgcctatgtacagctcgttatctactctggtcagaaccacagatccagagtatgtgttttcccccggcattatacctgagtcaaaccatagtacctgtgacaaaaagactatcccactcacatggacgggttaccttcccattgccggggaaatggagaaagttaccggatgcactgtgttctgtacactggcgggcccgggcgcaagctgcgaagcctattccgagcacgggatctttaatatatctagccctacctgtttggtccacaaggtgcagaaattcaggggatcagaacagaagattaacttcatctgccaacgggtagatcaggacgttgtggtctactgtaatggtcagaagaaagtgatcctaacaaaggacctggtcattggccagtgcatctatacttttaccagtctcttctccctgatgcccgatgtggctcatagccttgccgttgagctgtgtgtgccagggttgcacggatgggcaacggtaatgctcctgtctaccttttgcttcggctggattttaatacctgctatcacactggtcgtgctaaaatttctcaagatggccactttctcatgtagtcattacaccaacgagagcaaatttaagttcattctggaaaaggttaaagtggagtaccaaaagacaatgggttccatggtctgcgacatctgccaccatgaatgtgagactgcgaaagaacttgagtctcacaagcagtcgtgcatcaatgggcagtgtccctattgcatgaccatgacggaggccacagaaagcgcattgcaggctcactactccatttgtaaactgaccggccgctttcaagaggccctcaagaagtcactgaaacgaccagaagtgaagaaaggatgctatagaactcttggcgtattcaggtacaagagtcggtgttatgtggggctggtttggtgcgtcttgctcacatgtgagctgatagtgtgggctgcctctgcagagacccccttactggaaagcggatggtccgatactgcccatggtgtgggcgaggtccctatgaaaaccgacctagaactcgatttttcactgccatctagctccagttacagctatcgtcgcaagttgacaaacccggctaataaggaggaatctatccccttccactttcagatggagaaacaggttattcatgcggagatccagacgttggggcactggatggacgcaaccttcaacattaagactgccttccactgctacggagcttgtcaaaaatactcctatccttggcagacagccaagtgctttttcgaaaaagattaccagtatgagaccggctggggttgcaacccaggggactgtcccggctttggaacaggctgcactgcatgtggggtgtacctggataagctcaaatcagtgggaaaggcctataagatcataagtctgaaatacaccagaaaggtatgcatccagttaggtacggaacaaacatgtaaacatattgacgctaatgattgcctggtcacccctagcgtgaaggtttgtatcattggcactgtgtcgaaacttcagccatccgacacccttctcttcctggggcccctagagcagggaggcatcctgctcaagcaatggtgcacaacttcttgtgcctttggtgacccgggggatataatgagcaccacatcaggcatgaggtgccctgaacacacgggaagtttccggaagatttgtggctttgcaaccactccagtctgcgagtatcaggggaacacaatctccggatacaaacgaatgatggcgaccaaggactctttccagagctttaatctgactgatccccatattacaaccaacaaacttgagtggatcgaccctgatggcaatacgcgcgaccacgtgaacttggttctgaatagagatgtgtccttccaggacttatcagataacccctgcaaggtagacctccatactcaagctatagaaggtgcctgggggagcggagtcggctttaccctgacatgtaccgtgggtcttactgagtgcccaagtttcatcacatctattaaagcatgtgatatggccatgtgctacggctccaccgtgagcaatctggctagggggtcgaacacagtcaaggttgtgggaaagggcgggcactcaggattgcactctcggtgttgccatgacactgattgtagttccgaaggcctcgtagccagcgcacctcacctggagcgcgtgaccggttttaatcagatcgactctgacaaagtctatgatgacggggctcccccatgcacgttcaagtgttggttcacaaaaagcggagaatggctactgggcattctcaacggtaattggatcgtggttgtggtcctggtggttgtgcttatattttccattatcttgttcaacatcctgtgcccgagaaggggccataagaaaaccgtctga

SEQ ID NO: 10011 - RNA, 3417 nt, synthetic construct
  misc_feature 1..3417: note = derived and/or modified CDS sequence (opt3) from LECV(Of22819)__AF028022.1__GP
  source 1..3417: mol_type = other RNA
atggagggctggtacctgatcgtgctcggggtctgcagcacccttacactggccatgcccaagactatttatgaattgaaaatggagtgtcctcacacggttggattaggtcagggcataatcgtggggtccaccgaactgggactaattccaatcgagacagcttctgacctcaagctggaatcaagttgcaacttcgatcttcatactaccagcatgacacaaaaatcctacacccaggtagagtggagaaagaaatctgacactacagataccacgaatgcagccgcgactacctttgagtcgcaggctaagacagtgaacctgaggggcacttgtgtcttggccgcagaactctatgacaccctgaagaaagtgaagaaaacagttctgtgctacgatctcacctgtaatcagacgcactgccaaccgactgtgtatttaattgcccccgtcatcacatgtatgtcaatacggagctgcatggctagtgtgttcatctcccgcattcagatcatttacgagaagacccattgtgtaactggtcagctgatcgaagggcagtgctttaaccctgcacacacacttaccttggcccaaccagctcatacgtatgagaccgttacactgcccgtgacttgtttctttacccctaaaaagtctgaccagctaaagctcataaaaacattcgagggaattatcagcaagactggctgcaccgaaaatgccctgcagggctactacgtctgctttcttgggtcccactcagagccactgcacgtgcccagtttgaaagatattcgaagcgcggaagtggtcacacgtatgatcgttcatcctagaggagaggaccacgatccaatccagaactctcaaggttatctcaggattgtgggcccgctgaccgcaaaggtaccctccacttcaagcagtgacacgttacaggggacagccttcgctggagtgcctatgtactcttccctgagcaccctcgtccggaatactgatccagaatttgtgttctcgcccggcataatccctgagtctaaccattccgcctgtgacaaaaagaccattccacttacatggaccggttatctgcccatctcaggggagatggaaaaagttactggatgcacagtgttttgtacgttggcaggcccgggcgctagttgcgaggcctacagcgaatccgggatattcaatatttctagccctacctgtctagtcaacaaggtgcagaagtttcgcggatcagagcagaaaatcaatttcatctgccaaagagtagatcaggacgttgtggtctattgtaacggtcagaagaaagtgattctgactaagacactcgtcatcggccaatgcatttacaccttcacaagtctgttttcccttatgcccgacgtggcgcacagcctggccgttgaattgtgtgtgccagggctccacggatgggcaactgtaatgctgttatctaccttctgctttggctggatactgatccctgctattacgctagtcgtgctcaaagttctgaaggtggccaccttctcatgtagtcattatacaaatgagagcaagtttaaattcatccttgagaaggtcaaagtggaataccagaagactatgggttccatggtatgcgatatctgccaccatgagtgtgaaaccgctaaagagttggaatctcacaagcagtcgtgcattaacgggcagtgtccctactgcatgacaatgactgaggccaccgagagcgcactgcaagcccattttgctatatgtaagctcacgggcaggttccaggaagcgctgaaaaagtcccttaaaaagccagaggtgcggaaaggatgctatcgcacactgggcgtttttcgatacaagtcaagatgttatgtcgggttggtgtggtgcgtgctcctgacctgtgaattaatcgtctgggcagccagtgctgagactcccctgctagagtctggatggagcgacacagcccacggtgttggcgaagtgcctatgaagaccgatctcgagctggacttctcccttccatcatctagctcctacagttataggcggaaattgactaatccggcaaacaaggaagagagcattccctttcacttccagatggaaaaacaggtgatccatgccgagattcaaaacctggggcactggatggatgctacctttaatatcaagacagccttccattgctacggagcatgtcagaaatattcttacccttggcagacggcgaagtgcttctttgagaaagactaccagtatgaaaccggctggggttgcaacccaggggattgtcccggcgtaggaactggctgcacagcttgtggggtctacctcgacaagctgaagtccgtgggaaaagcctataagataatctcattaaaatacacccgtaaggtttgcattcaactgggtacagagcagacttgtaaacacatcgatgcaaatgactgccttgtgacccctagtgtcaaggtgtgtattgttggcacggtgagcaagttgcagccatcggatacactcctgttcctagggcccctggaacaaggaggcatcatactcaaacagtggtgcaccacttcctgtgcctttggtgacccgggggacattatgtctaccacaagcggcatgcgctgccctgagcacactggatcattcagaaagatctgtggctttgctaccacaccagtatgcgaatatcaggggaacacgattagtggatacaaaaggatgatggccaccaaggattccttccagtcttttaatctgactgacccccatatcacaaccaacaaacttgagtggatagatcctgacggcaatactcgggatcacgtcaacttggtgctgaatcgagacgtgagcttccaagatttatccgacaacccctgcaaggtcgatctccatacacaggcaatcgagggtgcttgggggtcaggagttggctttaccctgacgtgtactgtgggtcttaccgaatgccccagcttcatgacaagtattaaggcctgtgacctggcgatgtgctatggctctaccgtacacaatttggcccgcgggtccaacactgtgaaagtcgtgggaaagggcgggcatagcggatcgtcatttaaatgttgccacgatacagactgttctagtgagggcctcgttgcttccgcacctcacctggaaagagtgaccggtttcaatcagatcgatagcgacaaggtctacgacgatggggccccaccatgcacatttaaatgttggttcactaagtctggagagtggctactgggcattctcaacggtaattggatcgtggttgtggtcctggtagtggttcttatattcagcattatcttgttttccatcctgtgcccgaggcggggccataagaaaaccgtgtga

SEQ ID NO: 10012 - RNA, 3417 nt, synthetic construct
  misc_feature 1..3417: note = derived and/or modified CDS sequence (opt3) from ORNV(Ol22996)__AF028024.1__GP
  source 1..3417: mol_type = other RNA
atggagggctggtacctgatcgtgctcggggtctgcagcaccgttacacttgccatgcccaagactatttatgaactgaaaatggagtgtcctcacacggtgggattgggtcagggctacataatcgggtccaccgaattaaacctgattccaatcggagctgcatctgacctaaagctcgagtcaagttgcgatttcgacctgtatacaactccgatgacccagaaaagctacacacaggtagaatggagaaagaaatccgagaccactgatacaaccaatgccgcggctacgacttttgagtctcagaccaagacagtgaaccttaggggcacttgtattctggcctcggaattgtatgacaccctcaataagatcaaaaagcccgtcctgtgctacgatctgaactgtaatcagacacggtgccaacctaccgtgtatctcatagcaccagttatcacgtgtatgtcaattcgcagctgcatggccagtgtgtccaactctcgaatccagattatctacgagaaaactcattgtgtcacaggtcagttagtggaagggcagtgcttcaatcccagccacaccctgactcttgctcaacctgcacatacatacgagaccgtaacgttgccagttacctgctttttcacacccaagaaatccgaccagctgaagctagtgaagacttttgagggaataattaccaaaacaggctgtactgaaaacgccctccagggctattacgtctgcttcctggggtcacacagtgagcctcttcatgtgccaagcctggaagatatccgttctgctgaggtggtctccagaatgattgttcacccgaggggagaagaccacgatcccatccaaaattcacaaggtcatttgcggatcgtgggccctattaccgccaaggtaccaagcacaagttcttccgacaccctccaggggactgcgtttagcggagtgcccatgtattcgtctctgtccacgttagtccgctcagcagatcctgagttcgtgtttagtccaggcatactgcccgagagcaaccactccgtttgtgacaaaaagacactcccgcttacctggactggttacctgcctatctctggggaaatggagaaagtgaccggatgcacagtcttctgtaccttggccggccccggcgctagctgcgaagcctattcagagaatgggatttttaacatcagttccccaacttgtctagtgaataaggtacagaaattcagaggaagcgaacaaaagataaactttatttgccagaggatggatcaggacgttgtggtctactgtaatggtcagaagaaagtgatcctgacaaagacgctcgtcatcggccaatgcatttataccttcacttctctgttctcacttatgcctgacgtggcacatagtctggctgttgagttgtgtgtgcccgggctccacggatgggccacagtaatgctgttaagcaccttttgcttcggctggatcctgattccagcgataacacttgtcgtgctcaaatttctgaagatggccactttctcctgttctcactacaccaacgagtcgaaatttaagctaatcttggaaaaggttaaagtggagtaccagaagacgatgggtagcatggtctgcgatatttgccatcacgaatgtgagaccgcaaaagtgctggaatcccataagcagtcatgcatcaacgggcagtgtccctattgcatgacaatgactgaggctaccgagagtgccctccaagctcactactctatctgtaaactgacaggccggttccaggaagcccttaaaaagagcctgaaaaagcctgaggtaaaacgcggatgctatcgaactttgggcgtgtttagatacaagtccaggtgttatgttgggctcgtctggtgcgtgctgttaacctgtgaactgattgtgtgggcagcctcagctgagacgccactactcgagagcggatggtctgacacagcgcatggtgtcggcgaaataccgatgaaaaccgatctggagcttgacttctccttgcccagttctagctcctactcatatcggcgtaagctgactaatcctgcaaacaaggaagagagtatcccatttcacttccagatggaaaaacaggttattcacgccgagatccaaacactcgggcattggatggatgctacctttaatattaagactgccttccactgctacggagcatgtcagaaatacagctatccctggcagaccgccaagtgctttttcgagaaagactaccagtatgaaacaggctggggttgcaaccctggggattgtccaggcgtgggaacgggctgcaccgcttgtggggtgtacctggacaagttaaaatcggtaggaaaggcctataagatcatatccctgaaatacactcgcaaggtctgcatccaacttggtacagagcagacctgtaaacatattgatgcaaatgactgcttggtgacaccctctgttaaggtgtgtatcgtcggcactgtgagcaaactccagccgtcagataccctgctattcctggggcctctcgaacaaggaggcattatcctgaagcagtggtggacgacaagttgcgcgtttggtgacccaggggacataatgtccaccacttctggcatgagatgtcccgagcacaccggcagcttcaggaagatttgcggatttgctacaactcctgtttgtgaatatcaggggaacaccatctccggatacaaacggatgatggccacaaaggattcattccagagctttaatcttacggacccccacattaccactaacaaattggagtggatcgatccagacggcaatacacgagatcatgtgaacctggtattaaatcgcgacgtcagtttccaagatctctctgacaacccttgcaaggtggatctgcacacccaggcaatagagggtgcctgggggtccggagtgggctttactcttacatgcaccgtcggtctgacggaatgtcccagcttcatgacttcgatcaaggcttgcgacttggccatgtgttacggctcaaccgttacaaatctcgcaagagggtctaacaccgtgaaggtagtgggaaagggcgggcatagtggatccagctttaaatgctgtcacgatactgactgctctagcgagggcctggtcgcttccgccccacatctagaaagggtgacaggtttcaatcagattgattcagacaaggtttatgacgatggggcgccgccttgtacctttcggtgctggttcacaaaaagtggagagtggctgctcggcatcctgaacggtaactggattgtggtcgtggttcttatcgtggtcttgatatttagcattgtactgttctctatcttatgtccccgcagaggccacaagaaagccgtgtga

SEQ ID NO: 10013 - RNA, 3426 nt, synthetic construct
  misc_feature 1..3426: note = derived and/or modified CDS sequence (opt3) from BCCV__L39950.1__GP
  source 1..3426: mol_type = other RNA
atgggcagactgtacctcatcgtgcttggggtcctgattaccgccacagctggattccccaggagcgttcacgagttgaagatagaatgccctcatactgtggtattaggtcagggctatgtgacggggtccgtcgagctgggatttatcgcactagaccaagtgaccgatctcaaaattgaatcttcatgtagtttcgaccaccatgccgcgccaacaactacccagaactttacacagctgaagtgggctaaaaccgccagcactacagataccacgaatgcagccgagactaccttcgaatccaagtctacagaggttcaccttaaaggcgtgtgcactatcccgtcgaacgtcctggacggtccctcacggcctgtgaccgggcgcaagacagtagtttgttacgatttggcttgcaatcagacccattgtcaaccaacggtgcacctcctggcacccattcagacttgcatgagcgtccgaagttgtatgatctccctgctcgcctctcgtatacaggtggtgtatgagaagacatactgcgtcaccggacagttaatcgaaggcctgtgttttaaccctgttccaaatcttgctttgactcaacccggccacacatatgacaccttcacgctgcctattacctgctttctagtggccaaaaagggggcgaacctcaaaatcgcagtagagctggaaaaacttacaactaagaccggatgtgccgagaatgctctgcaggcctactatatttgcttcatcggtcagcatagcgagccattgacagtgccgatgctcgaagattacagatccgcagagatatttactaggattatgatgaaccccaagggcgaagaccacgatatggagcagtcaagtcaaggggctctgcggatcgtcggacctattaagggcaaagtgccacccaccgaaacaagcgacaccgttcagggtatcgccttcgcggggttacctatgtactcttccttttcaagcctggtgcgcaaggccgagccagagtatctcttcagtcccggaatcattgcagaatctaatcattccagctgcgataaaaagactcttccgctgacgtggagaggctttttgtcgatgtctggcgagatagaaaggatcacagggtgtaacgtcttctgcaccctagctggacctggtgcctcctgtgaggcttactcagaaaatggcattttcaacatcagtagccccacttgcctggtgaataaagtacagaagtttcgggggtccgagcaacgcataaacttcatttctcagcgaatcgaccaggatgttatcgtgtattgtaatggacagaaaaaggtcattctcaccaagacactggtgatcggccaatgcatttacacctttactagcatattctcacttatcccaagtgtcgcccactccctggcagtggagttgtgtgttcctggtattcacgggtgggccacaatcgctctcgtgatcacgttttgcttcggctggctgttaattcccaccactacaatggtagtcctgaaatgtctaagactcctgacctatagctgctctcattactcaacagaaagtaagtttaaagtgatacttgagaaggttaaagtggaatatcagaagactatgggaagcatggtctgtgacatctgccaccatgagtgcgaaaccgcgaaggagttggagtcccacaaaaagtcttgtgcagacggccagtgcccatactgtatgacgattaccgaagccacagagtcggctctgcaggcccattacgcagtgtgcaaactcactgggaggttccacgaagccctgaagaaaagccttaagaagcccgaggtacaacggggatgttatcgtaccctgggtgtgtttcgctacaaatccagatgctatgttggcttggtctggatgtgtctcctgacattagagctgatcgtgtgggctgcctcagcagatactcctctactcgaaccagggtggagtgacaccgcgcacggagtgggcgatattccgatgaagacggacctggagcttgatttcgctatcccctctagctcctcatacagctataggcggcgattggtcaaccctgccaactctgacgaaacagttccatttcatttccagctggagcgccaggtgatacacgcagaaatccagtccctcggtcattggatggatgccacctttaatattatcagtgctttccactgctacggggagtgtaaaaagtatagctacccctggcaaactgccaaatgcttctttgagaaggactaccagtatgaaacatcttggtcctgtaaccctccagattgccccggcgtgggaaccggctgcactgcatgtgggatttacctggacaagttaaaatcagtaggaaaggcttataaagtcatcaccctgaagtacgccagaaaagtgtgcatacagcttggtacagagcagacgtgtaagaatattgatgttaacgactgcttggtgaccagtagcatcaaagtctgtatgattggcactatctcgaagttccaaccgggggacacactcctgtttctaggacctctggaagagggcggtctcgtgctgaagcagtggtgcaccacaacttgttccttcggggatccaggcgacataatgtctaccacgagcggaatgaggtgccccgaacacacaggctcatttcggaaaatctgtgggttcgcgaccactcctgtttgcgagtatcagggaaataccgtgagtggctttaagcgccttatggccacaaaagattccttccaatcttttaacgtaagcgaggtccatattactaccacaaagttggaatggtccgaccccgattcaaatatcaaagaccacattaacctgatcttaaatagagatgtgagcttccaggacctcagtgataacccatgtaaggtggacctgtctacgcaggctatagatggtgcatgggggtccggagtcggctttacccttacttgcattgttggtctgacagagtgcagctcgttcatgacctcaatcaaggtgtgtgacatggccatgtgctacggcgcttctgtagtgaatttggtcagggggagtaacactgtgaaaatcgttggaaagggcgggcattccggaagcacatttcgttgttgccacgataaagactgtacctctaatggcctcctggccagcgcacctcatctagaacgggtgacgggtttcaaccagattgactccgataaggtctatgacgatggggcgcccccatgctcaatcaaatgttggttcgccaagagtggagagtggctgctcggcattctgaatggtaactgggtggttgtggctgtccttgtaataatcttgctgattagcatctttttattctcctttttctgcccgattcgatctcacaagaaacaactctga

SEQ ID NO: 10014 - RNA, 3408 nt, synthetic construct
  misc_feature 1..3408: note = derived and/or modified CDS sequence (opt3) from DOBV(DOBV/Ano-Poroia/Afl9/1999)__NC_005234.1__GP
  source 1..3408: mol_type = other RNA
atgatcatgtggggcctgctccttaccatgattctgatagacttcggggccagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcgcactgtcccaccggatggtggaggaatcttatcgcaatcgacgtagcgttatctgttacgacttgtcctgcaactcaacccattgtaagcccacaatgcacatgatagtgcctgtccatagttgcaatatgatgaaaagctgtctcgtggggctgggaccatatagaatccagattgtatacgagaggacctattgcactacaggcatcctgaccgaaggtaagtgttttgttcccgatcagtctattgtgaacgtcatcaaaaatggggtgttcgacatagcctccgtgtcaattgtctgctttttcatccgggttaagggaacgaactacaagattatggctagcatcaaaactgcaaccgccaataactgtaatgatacagacaacaaggtgcaaggctattacctctgcatcgtaggcgggaatagttctcctgtgtacgctccatccactaccgattttcgcagcatggaggccttagcgtcgctgcttagagcaccccacggagaggaccacgatttgtctggtgaagaggtcgccacatattccattgctggccagatagaagggaaaatccctcataccgccaacgcagctaacatgctgttcacggccttttcagggattccaagttacagctccctatctgtgttcatcggcagccaggacggtccggttatatattcacccgggctctttcctaggctgaatcagagttcctgcgacaagattgcgcttccactgatctgggagggatacatcgatttgcccggctattacgaaactgtgcacccttgtaacgtcttctgcgtgctcagcggcccaggggcctcttgtgaggcattttcagagggaggtattttcaatatcacaagtccgacctgcctggtaagcaaacaaaaccggttccgcgctgccgaacagcaggttaattttgtgtgtcagcgagtcgaccaagatattgtgatatattgcaacggccagaagaaaactatcttaacaaagaccctggtcattgggcagtgtatctactccgtgacgtctctcttctcgatcatgcccggagttgctcatagcattgccatagagctttgcgtgcctggctttcacggttgggcaaccgccgctctgttgacaactttctgttttgggtggatcctaattctgtccatcaccctcgcggtactggtcgtgcttaagttctttgcagccattctgcacaattcaagtcaagaaaacagattcaaaatcatattgaggaagatcaaagaggaatttgagaagacaaaaggctctatggtttgcgaggtgtgtaagtacgaatgcgagactggaaaggaactcaaagctcataatctgagctgcccccagtcccagtgtccatattgcttcacccactgtgagcctacagaatcagcctttcaggcacattacaaggtctgccaagccacccaccggttccgtgacgatctgaaaaagactattacgccccagagcacatctccaggctgttatcgcaccttaaacctatttagatacaaatccaggtgctatatcttcactgtgtgggtaaccctcctgattatcgagagtataatgtgggctgccagcgcatctgagacagtgcttgaaccctcctggaatgacaacgcgcatggggttggagtcgtgcctatgcacaccgatttggagctggacttctcactcccaagtagctcgaagtacacttataagcggaaactgacatccccgcttaatcaggaacagtctgtggatctgcacattgagatcgagagccaaggtatttcaacgagtgtccatgctttgggccactggtttgacgggcgactcaacctgaagacctccttccattgttacggagcctgcactaaatacgaatatccctggcacacagcaaagtgtcactttgagcgcgatttcgaatacgagaataactggggctgcaaccctgccgactgtccaggtatcgggaccggctgcacagcttgcggattatatatagaccagctgaaacccgttggctctgcctacaagctaatcactgtgagatatagcaggaaggtgtgtgtacagtttggggaagagaatctctgcaaaaccattgatatgaacgactgtttcgtcacgcggcatgtgaaggtttgcatcattggaaccgtgtccaaattttcacagggtgatacactggtcttccttggccctatggagggaggaggcttgatctttaaggactggtgtactagcacatgccaattcggtgatccaggggacataatgagtcccaaagataagggcttttcttgtccggacttcaccggacactttcgcaaaaagtgcaatttcgcaactacccctgtgtgtgaatacgatggcaacatggtttccgggtataagaaagtgatggctacgattgacagcttccagtcgtttaatacatcatctatccattacaccgatgagagaatcgaatggaaggacccagatggaatgctgaaagaccacctcaacattctggtaactaaggacatcgatttcgagaatttaggcgaaaacccctgcaaagtcggtctgcagacaagttccattgagggggcctggggaagcggcgtgggttttacccttacttgtcagatatctttgaccgagtgcagcaggttcctcacatccatcaaggcgtgcgacatggccatttgttacggcgctcaatcagtgacgctgatccgtgggcagaataccgtcaaggttagtggaaaaggcgggcatagcggatcttcctttaagtgctgtcacggcactgattgctcacagcaaggtctacaggcaagtgcccctcacctggacaaagtgaacgggattgtagaacaggagagcgaaaaggtgtatgatgacggagctccccagtgtggcatctcctgctggttcgtcaaatctggtgagtggataacaggcatctttaatgggaactggattgtgatcgttgtgctcgtcttctttttcattctgtcgcttatcttgctgagcttactctgtccaatacggaagcataagcgatcatga

SEQ ID NO: 10015 - RNA, 3408 nt, synthetic construct
  misc_feature 1..3408: note = derived and/or modified CDS sequence (opt3) from DOBV(DOB/Saaremaa/160V)__AJ009774.2__GP
  source 1..3408: mol_type = other RNA
atgatcatgtggggcctgctccttaccatgagcctgattaacttgggggcctccttaagaaatgtgtacgacatgaagatagagtgcccccactctatcaacttcggagaatcaagtgtcacaggtaaagttgagctgcctccaattctactcactgatgctgaagcactggtgccggagagctcctgtaatatggacaaccatcagtctctttcgatcacgcaaaaggtaaccaaagtgtcatggaggaagaaagccgatcaggtccaggcggctaaggacagctttgaaacaacttctaatgagattaacctgaaggggacctgcacattgacccaccggatggtggaggaatcctatcgcaatcgaaaatctgttatctgttacgatctcagctgcaactccactcattgtaagcccacaatgcacatgatagtgcctgtccattcatgcaatatgatgaaaagttgtctggtggggctgggaccatatcgtgtacaggttgtgtacgagagaacctattgcacgactggcatcctcaccgaaggtaagtgtttcgtccccgaccaaagcattatctctgtgattaaaaacggggtgtttgatatcgcctccgtctcaatagtttgcttctttattagggtgaagggaacaagctacaagatcatggcaagtattaaaacttctaatcctaacaattgtaacgacaccgataataaggtacagggctattacttatgcatcgtgggcgccaactccagcccagtctacgctccctcgacaaccgacttccggtctacggaggcactggcctcccttttgcgctcacctcacggggaggatcacgacctgagtggagaagaggtggctacttatagcatcgccggtcagattgaaggcaaaataccacatacagcgaacgcagccaatatggcttttaccgccttctccgggatcccgtcttacagctcactaagtgtttttgcaggaaaccaggatggcactattatcttctcccccggtctctttcctaagctgaatcaaagctcttgcgacaaagtggctttaccactgatatgggaggggtatattgacttgcccggatactatgaaacaatccacccttgtaacgtcttctgcgtgctctcaggcccaggcgccagttgtgaggcgtttagcgagggcggaatcttcaatattacctcccccacgtgcctggtatctaagcagaacagattcagggccgcagaacagcagatcaattttgtttgtcaacgggtggatcaggacattgtcatatactgcaacggtcagaaaaagaccatcttaacaaagactctggtgattggccaatgtatctattcggtcaccagcctcttctccatcatgccgtcagtggctcatagtattgccatagagctttgcgttcctgggtttcacggatgggctacagccgcactgttgactaccttctgttttggctggatcctaattccctctatcacactggccgtgctcattgtactgaaattctttgctgcgatccttcacaatagctcccaggaaaaccgcttcaagataatcctgcgaaaaattaaggaggaatttgagaaaaccaagggttcaatggtctgcgaggtgtgtaagtacgaatgcgagactgggaaagaattgaaggcacataatctcagctgcccacagtctcagtgtccttactgcttcacgcactgtgagctgacagaatccgcctttcaagctcattatagagtttgccaggccacccacaggttccgggatgaccttaaaaagactatcacaccccagagtacaagcccaggctgttaccgtaccctgaacctatttcgctataaatctagatgctacattttcactgtgtgggtcgtgctcctgatcatagagtccattctttgggcagcctcagctagtgagttggtactggaacccaattggaacgataatgcccatggagtgggcatcgttcctatgcacacagacctcgagctggatttcagccttccatcgtcctctaagtatacgtacaagaggaaactgaccagcccgattaaccaggaacaatcaatcgacttgcacatagagatcgagagtcaggggatttccacttctgtccatgcactcggacactggtttgatggtcggctgaacttaaagaccagcttccattgttatggcgcgtgcaccaaatacgaatacccctggcacacagctaagtgtcactttgagcgagacttcgaatatgagaataactggtcctgcaatcctccagattgtcccgggatcggaactggctgcaccgcctgcggtctgtacctagaccagctcaaacctgtggggtcagcatataagctgattacggtgcgctacagcagaaaggtctgtgttcagtttggcgaagagaacctttgcaaaaccatcgacatgaatgattgtttcgtgacaaggcatgtgaaggtatgcataattggaactgtcagtaaattttctcaaggcgacaccttggtgttcctggggccaatggagggaggtggcctcatctttaaggattggtgtacaactacctgccagttcggggaccccggagatatcatgtccccgaaagacaagggctttagctgtcctgatttcacgggtcactttcggaaaaagtgcaacttcgccacaaccccagtttgtgaatatgacgggaatatggtgtcgggctacaagaaagtcatggctactattgattcattccaggcctttaacacatcttatatccattacaccgacgagcagattgaatggaaggatcccgacggaatgctgaaagatcacttaaatatactggtgactaaggacatcgacttcgagaaccttggcgaaaatccttgccgcgttgggttgcaaaccgcaagtattgagggagcttggggctccggtgtggggtttacactcacgtgtcagatcagcctgaccgagtgctctagattcctaactagcattaaagcctgcgatatggcgatctgttacggagcccagtccgtaacactggtcaggggccaaaacaccgtgaaggtgtcaggtaagggcgggcatagtggaagctcttttaaatgctgtcacggcaatgactgctcccagcaggggctccaggcttcagcaccccacctggataaggtcaacggaatagttgaacaagagagtacacaggtgtatgacgatggcgccccacagtgtggtatcagctgctggttcattaaatccggggaatggatcaagggaatttttagtggcaattggatcgtaatagtggtccttattgtgttgttcatcctgtcgttaatcctcctgagctttctttgtcctattcgtaaacataagcggtcatga

SEQ ID NO: 10016 - RNA, 3408 nt, synthetic construct
  misc_feature 1..3408: note = derived and/or modified CDS sequence (opt3) from DOBV(East Slovakia/400Af/98)__AY168577.1__GP
  source 1..3408: mol_type = other RNA
atgatcatgtggggcctgctccttaccatgattctgatagacttcgggactagcttgagaaacgtgtacgatatgaagatcgagtgcccccactccattaattttggagaatcttcagtcactggtaaagttgagttacctccactgctactcacggacgccgaagctctggtgccggagagtagctgtaacatggataatcatcagtccatgtctatcattcaaaaggtaaccaaagtgtcgtggaggaagaaagcagacaaggcccaggcggctaaggattcattcgaaacaactagcagtgaggtcaaccttaaagggacctgcacactgtcccaccggatggtggaggaatcttatcgcaatcgacgtagcgttatctgttacgacttgtcctgcaactcaacccattgtaagcccactatgcacatgatagtgcctgtccatagttgcaatatgatgaaaagctgtctcgtggggctgggaccatatagaatccaggtagtttacgagaggacatattgcaccacgggcattctgactgaaggtaagtgttttgtgcccgatcagtctatcgtcaacgtgattaaaaatggggtgttcgacatcgcctccgtctcaatagtttgctttttcattcgggtgaagggaaccaactacaagatcatggcaagcattaaaacagccactgctaataactgtaatgataccgacaacaaggtacaaggctattacctctgcatcgtgggcgggaatagttctcctgtctacgcaccatccacaaccgattttcgcagcatggaggccttagcttcgctgcttagagctccccacggagaggaccacgatttgtctggtgaagaggtggcgacgtattccatcgcaggccagattgaagggaaaatacctcatactgccaacgctgccaacatgctgttcacagcattttcaggaatcccaagttacagctccctatctgtttatattggcagccaggacggtccggtggtctactcacccggcctcttccctaagctgaatcagagttcctgcgacaaagtggcccttccactgatctgggagggatatatagatttgcccggctactatgaaaccgtacacccttgtaacgtgttttgcgttctcagcggcccaggggcctcttgtgaggcgttctcagagggaggtatttttaatatcacaagtcccacatgcctggtcagcaagcaaaacaggttccgggccgcagaacaacaggtgaatttcgtctgtcagcgcgtggaccaggatatcgttatttactgcaacggccagaaaaagaccatcttaacgaagaccctggtgattgggcagtgtatatactccgtaacatctctcttttcgatcatgccgggagtcgctcatagcattgccatcgagctttgcgtgcctggcttccacggttgggctactgccgcactgttgaccacattttgtttcgggtggatcctaattccctccataactctggccgttctcgtggtcctgaaatttttcgctgcgatccttcacaattcaagtcaagaaaaccgatttaagattatcctgagaaaaattaaggaggagttcgagaaaaccaagggctctatggtgtgcgaggtatgtaagtatgaatgcgagacaggaaaagaattgaaggcacataatctcagctgcccacagtcccagtgtccttactgctttacccactgtgagcccactgaatcagccttccaggctcattataaagtgtgccaagccacgcacaggtttcgggacgatctgaagaaaacaatcaccccacagagcacttctcccggctgttaccgtaccttaaacctgttccgctataagtccagatgctacatatttacagtttgggtcaccctactcatcattgagagtatcatgtgggcagccagcgcttctgagaatgtgctggaaccttcctggaacgacaatgcccatggggtgggagtcgttccaatgcacactgatcttgagttggacttctcactgccgagtagctcgaagtatacatacaaaaggaagctcacgtctcccctgaaccaggaacagtccgtggatcttcacattgagatcgagagccaaggtatatcaaccagtgtgcatgcactgggccactggttcgacgggcggttgaatctcaaaacttcctttcattgttacggagcgtgcacaaagtatgaatacccttggcacaccgctaaatgtcacttcgagcgagattttgaatatgagaactcttggggctgcaacccagccgactgtcccggtattgggacaggctgcactgcatgcggactgtacatcgaccagttaaagcctgtaggcagcgcctataagctgattaccgtccgctactccagaaaagtgtgtgttcagttcggggaagagaatctatgcaagacgatcgatatgaacgactgttttgtgaccaggcatgtcaaagtgtgcataatcggaacagtttcaaagttcagccagggtgatactctcgtgtttctgggcccaatggaagggggaggccttattttcaaagactggtgtaccagtacatgccaatttggtgatcccggggacatcatgtctccgaaggataaaggcttctcctgtcctgactttactggacacttccggaagaagtgcaattttgctaccacgccagtatgtgaatatgatggcaacatggtcagcgggtacaaaaaggtgatggccacaattgactcgttccagtcattcaatacctctagtatccattacactgatgagcgcatagaatggaaagaccccgatggaatgttgaaggaccacctgaacattctcgtgacaaaagacatcgattttgagaatctgggcgaaaacccttgcaaggtcggtttacagacctccagcatcgagggggcatggggatctggcgttggtttcactctgacctgtcagattagccttacagagtgctccagatttttgacgtcaatcaaggcttgcgacatggccatttgttatggcgcgcaaagtgtgaccctcataagggggcagaatactgtaaaagtgagcggaaagggcgggcattctggatcctcattcaaatgctgtcacggcacagattgcagtcagcaaggtctgcaggccagcgctccccacctagacaaggtcaacgggatcgtggaacaggagtccgaaaaagtttacgatgacggagcaccacagtgtggcatttcttgctggtttgtgaagtcgggtgagtggatcaccggcattttcaatgggaactggatcgtcatagtggttctgatctttttctttattctcagcctgatccttttgtcactgttatgtcctattcgtaagcataaacggtcctga

SEQ ID NO: 10017 - RNA, 3408 nt, synthetic construct
  misc_feature 1..3408: note = derived and/or modified CDS sequence (opt3) from DOBV(East Slovakia/862Aa/97)__AY168578.1__GP
  source 1..3408: mol_type = other RNA
atgatcatgtggggcctgctccttaccatgagcctgattaacttgggggcctccttaagaaatgtgtacgacctgaggatagagtgcccccactctatcaacttcggagaatcaagtgtcacaggtaaggttgagctacctccaattccgctcactgatgctgaaacgctggtgcccgagagctcctgtaatatggacaaccatcagtctctttcgatcacccaaaaagtaacaaaggtgtcatggcggaaaaaggcagataaagtccaggccgcgaaggacagctttgaaactaccagttccgagattaatctgaagggcacatgcaccttggctcaccgcatggtggaggaatcttatcgaaaccgtaaaagcgttatctgttacgatctctcctgcaattcaactcattgtaagcctacaatgtatatgatagtgccagtccacagttgcaacatgatgaaaagctgtctggtggggctgggaccctacagaatccaggtagtttatgagaggacctactgcacgactggcattctcatcgaaggtaagtgtttcgtgcctgaccagtctattatctccgtcataaagaatggggtgtttgatattgcctcagtgagcatcgtctgcttctttattcggatcaagggaaacagttataagatcatgaccaatattaaaacagcaaacccaaataactgtaatgacactgataacaaggttcaaggctactacttatgcatagtgggcgccaactcttcccccgtatatgctcctagcaccacagacttccgctcgatggaggtgctggcatctcttttgagatccccacatggggaggatcacgacctgtcaggagaagaggtcgccacctacagtatcgctggtcaggtggaaggcaaagttccgcacacggagaatgccgcgaacatgctatttactgcattcagcgggattccctcctattctagcctctcagtgtttgccggaaatcaggatggcacagtcatctacagtcctggtctgttcccaaaacttaaccagtccagctgcgaaaaagtggctctgcccttgatatgggaggggtatattgacctccctggatactatgagaccatccatccatgtaatgtattttgcgttctgtctggccccggcgcctcatgtgaagcattcagtgaagggggaatctttaacattactagcccgacatgcttagtgtccaagcaaaataggttccgggctgccgaacagcagatcaacttcgtctgtcagcgcgtggaccaagatattgtcatatactgcaatggtcagaaaaagaccatcctgacgaagaccctcgtgattggccagtgtatctactctgttacatcgctttttagcatcatgcctggggtggcgcactccattgccatagagctgtgcgtacccggattccatggctgggcaactgctgccttgctaaccacattttgtttcggttggatcctgattccatcaatcactctcgctattctgatcgtccttaaatttttcgccgcaatactgcacaacagttctcaagaaaatcgatttaaggtgatcttgagaaaaattaaggaggagttcgagaaaaccaaggggagcatggtttgcgaggtgtgtaagtatgaatgcgagacaggcaaagaactcaaggcccacaacctgtcctgccctcagtcacagtgtccctactgctttacccattgtgagttaactgagagcgctttccaggcgcactatagggtctgccaagcaacgcatcggtttcgtgacgatctgaaaaagacaatcaccccacagtctacttcccccggatgttaccgcaccctaaatctcttcagatataaaagtaggtgctacatttttacagtgtgggtagtgctgcttatcatagaaagcattttgtgggccgcttctgcctccgagatcgttctggaaccttcatggaacgacaatgcacacggcgtcggggtggtgccaatgcataccgatctcgagctggacttcagtcttccgagctcgtccaagtatacttacaagcggaaactgacatctcccattaaccaggagcagagcgtcgatttgcacatcgaaatagagtcacaacgaatcagtacgtccgttcacgccctcggacattggttcgacggtcgcctgaacttaaagacctcttttcactgttacggcgcttgcactaaatatgaatacccttggcatacagccagatgtcacttcgagagggattttgaatatgagaatagctggtcctgcaacccagcagactgtcccgggattggaaccggctgcacagcgtgcggtctgtacctagatcagctcaagcctgtggggtcagcttataaactgatcactgtgcggtacagccgcaaggtatgtgtccagttcggcgaggaaaatctttgcaagattatcgacatgaacgactgttttgtgagtagacacgttaaagtgtgcataattggaaccgtctctaagttctcccagggcgatacgttggtgtttctggggccaatggagggaggtggcctcatcttcaaagactggtgtaccacaacttgccaatttggggatcccggagacatcatgagcccgaaggataaaggcttctcgtgtcctgactttaccggtcatttcaggaagaaatgcaattttgccacaactccagtttgtgaatatgatgggaacatggtgtcaggctacaagaaggtaatggcaaccattgactctttccaggccttcaatacgagttacatccactatacagatgagcgtattgaatggaaagaccccgatggaatgctgaaggaccatataaacatcttagtcaccaaagatattgactttgagaatctgggcgagaacccttgcaaggtggggcttcagactgcttccatcgaaggagcctggggcagcggtgtggggttcacattgacctgtcagatttctctcactgagtgcagccggtttctgacctccatcaaagcatgcgacatggctatatgttacggagcccaatcagtcacgctagttcgaggccagaatacagtgaaggtaagtggtaagggcgggcacagcggatcttccttcaaatgctgtcatggcaccgattgctcacagcaagggctgcaggcgagtgctccccacctcgacaaggtgaacggaatcgtcgaacaggagagcactcaggtgtatgatgacggcgccccacaatgtggtatttcctgctggtttatcaaatctggggaatggattaagggaatcttcaatggcaactggatagttattgtggtcctgatctttttctttatcctttcgttgattctgctcagcttcttatgtcctataagaaaacacaagaggtcatga

SEQ ID NO: 10018 - RNA, 3408 nt, synthetic construct
  misc_feature 1..3408: note = derived and/or modified CDS sequence (opt3) from DOBV(A35)__GU904036.1__GP
  source 1..3408: mol_type = other RNA
atgatcatgtggggcctgctccttaccctgagcttgatttccttaggggcctctctgagaaacgtgtacgacctaaggatagagtgcccccactcaatcaatttcggagaaagtagcgtcacaggtaaggttgagctccctccaattccgctgactgatgctgaaacgcttgtgcccgagtcctcttgtaacatggacaatcatcagtcgctgtcaatcacccaaaaagtaacaaaggtgagctggcggaaaaaggcagataaagtccaggccgcgaaggacagttttgaaactacctcctctgagattaacttgaagggcacatgcaccctcgctcaccgcatggtggaggaaagctatcgatcccgtaaatcagttatctgttacgatctgagttgcaatagcactcattgtaagcctacaatgtatatgatagtgccagtccactcttgcaacatgatgaaatcctgtctggtggggctcggaccctacagaatccaggtagtttatgagaggacctactgcacgactggcattttaatcgaaggtaagtgtttcgtgcctgaccagtcaattatcagcgtcattaaaaatggggtgtttgatatagccagtgtgtctatcgtctgcttctttattcggatcaagggaaactcctataagatcatgaccaatattaaaacagcaaacccaaataactgtaatgacactgataacaaggttcaaggctactacctgtgcatagtgggcgccaatagctcgcccgtatatgctccttctaccacagacttccgctccatggaggtgcttgcatcattgctgagaagtccacatggggaggatcacgacctaagcggagaagaggtcgccacctactccatcgctggtcaggtggaaggcaaagttccgcacacggagaacgccgcgaacatgctctttactgcattctctgggattcccagctattcaagtctgtccgtgtttgccggaaatcaggatggcacagtcatctacagccctggtcttttcccaaagctgaaccagtcttcatgcgaaaaagtggctttgcccctcatatgggaggggtatattgacctgcctggatactatgagaccatccatccatgtaatgtattttgcgttttaagtggccccggcgccagctgtgaagcattctccgaagggggaatctttaacattacttctccgacatgcctggtgtcgaagcaaaataggttccgggctgccgaacagcagatcaacttcgtctgtcagcgcgtggaccaagatattgtcatatactgcaatggtcagaaaaagaccatcctcacgaagacccttgtgattggccagtgtatctacagcgttacatccctgttttcaatcatgcctggggtggcgcacagtattgccatagagttgtgcgtacccggattccatggctgggcaactgctgccctactgaccacattttgtttcggttggatcctcattccatctatcactctggctattcttatcgtcctgaaatttttcgccgcaatattgcacaacagctcccaagaaaatcgatttaaggtgatcctcagaaaaattaaggaggagttcgagaaaaccaaggggtcaatggtttgcgaggtgtgtaagtatgaatgcgagacaggcaaagaactgaaggcccacaacttaagctgccctcagtctcagtgtccctactgctttacccattgtgagctgactgagtccgctttccaggcgcactatagggtctgccaagcaacgcatcggtttcgtgacgatctcaaaaagacaatcaccccacagagtactagccccggatgttaccgcaccctaaatctgttcagatataaatctaggtgctacatttttacagtgtgggtagtgcttttgatcatagaatccattctgtgggccgcttcagccagtgagatcgttctcgaacctagctggaacgacaatgcacacggcgtcggggtggtgccaatgcataccgatctggagcttgacttctcgctgccgtcctctagcaagtatacttacaagcggaaattgacatcacccattaaccaggagcagagtgtcgatctccacatcgaaatagagtcccaacgaatctctacgagcgttcacgccctgggacattggttcgacggtcgcttaaatctgaagacctcctttcactgttacggcgcttgcactaaatatgaatacccttggcatacagccagatgtcacttcgagagggattttgaatatgagaactcatggagctgcaacccagcagactgtcccgggattggaaccggctgcacagcgtgcggtctatacctcgatcagctgaagcctgtggggagtgcttataaacttatcactgtgcggtactctcgcaaggtatgtgtccagttcggcgaggaaaatttgtgcaagattatcgacatgaacgactgttttgtgtccagacacgttaaagtgtgcataattggaaccgtcagcaagttctcgcagggcgatacgctggtgtttctcgggccaatggagggaggtggcctgatcttcaaagactggtgtaccacaacttgccaatttggggatcccggagacatcatgtcaccgaaggataaaggcttctcttgtcctgactttaccggtcatttcaggaagaaatgcaattttgccacaactccagtttgtgaatatgatgggaacatggtgagtggctacaagaaggtaatggcaaccattgactccttccaggccttcaatacgagctacatccactatacagatgagcgtattgaatggaaagaccccgatggaatgttaaaggaccatataaacatcctggtcaccaaagatattgactttgagaatcttggcgagaacccttgcaaggtggggttgcagactgcttctatcgaaggagcctggggcagcggtgtggggttcacactcacctgtcagatttccctgactgagtgctcacggtttctaaccagtatcaaagcatgcgacatggctatatgttacggagcccaaagcgtcacactggttcgaggccagaatacggtgaaggtatctggtaagggcgggcactccggatcaagtttcaaatgctgtcatggcaccgattgcagccagcaagggctccaggcgtccgctccccacctggacaaggtgaacggaatcgtcgaacaggagtctactcaggtgtatgatgacggcgccccacaatgtggtatttcgtgctggtttatcaaaagcggggaatggattaagggaatcttcaatggcaactggatagttattgtggtccttatctttttctttatcttgtcactgattttactctccttcctgtgtcctataagaaaacacaagaggagttga

SEQ ID NO: 10019 - RNA, 3408 nt, synthetic construct
  misc_feature 1..3408: note = derived and/or modified CDS sequence (opt3) from DOBV(A6)__GU904033.1__GP
  source 1..3408: mol_type = other RNA
atgatcatgtggggcctgctccttaccatgattctgatagacttcggggccagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcaccctgtcccaccggatggtggaggaatcttatcgcaatcgacgtagcgttatctgttacgacttgtcctgcaactcaacacattgtaagcccaccatgcacatgatagtgcctgtccatagttgcaatatgatgaaaagctgtctcgtggggctgggaccatatagaatccaggtagcatacgagaggacttattgcacaaccggcattctgacggaaggtaagtgttttgttcccgatcagtctatcgtgtccgtcattaaaaacggggtgttcgacatcgcctcagtgagcatagtctgctttttcattcgggttaagggaactaattacaagatcatggctagtattaaaaccgcaacagccaacaattgtaacgatactgacaataaggtgcaaggctattacctctgcatcgtaggcgggaactcttcccctgtgtacgctccaagcaccacagattttcgctcgatggaggccttagcgtctctgcttagagcaccccacggagaggaccacgatttgtccggtgaagaggtcgccacctattcaatcgctggccagattgaagggaaaatacctcatacggccaatgcagctaacatgctgttcactgcctttagtggaatcccaagctactcctctctaagcgtgttcattggctcacaggacggtccgatcatatatagtcccgggctctttcctaagctgaaccagtccagctgcgacaaagttgcgcttccactgatttgggagggatacatcgatttgcccggctattacgaaacagtgcacccttgtaatgtcttctgcgtgctctctggcccaggggcctcatgtgaggcatttagtgagggaggtatcttcaacattaccagccccacttgcctggtatccaagcaaaataggttccgggctgccgaacagcaggttaactttgtgtgtcagcgcgtcgaccaagatatcattatatattgcaatggccagaaaaagacaatcttaaccaagacgctggtgattgggcagtgtatctactctgtcaccagcctcttctcgatcatgccgggagtggctcattccattgccatagagctttgcgttcctggctttcacggttgggcaacagccgctctgttgactaccttctgttttgggtggatcctaattccctcaatcacactggcggtgctcgtagtcctgaaattctttgcagccattcttcacaacagttctcaagaaaatcgattcaagatcatactgagaaaaatcaaggaggaatttgagaaaactaagggcagcatggtgtgcgaggtttgtaagtacgaatgcgagaccggaaaagaattgaaggctcataacctctcctgcccacagtcacagtgtccttattgcttcacacactgtgagcccaccgaaagcgcctttcaggcacattacaaagtgtgccaagccactcacaggttccgggacgatctgaagaaaacgattacaccacagtctacctcccccggctgttatcgtactttaaatctgtttcgctacaagagtagatgctatatcttcaccgtctgggtgacactactcattatcgagagcataatgtgggctgcctctgcatccgagaacgtactggaaccttcatggaatgacaacgcgcatggggtgggagttgtcccaatgcacaccgatcttgagttggacttcagtctgccgagctcgtccaagtacacttataaaaggaagctcacatctcccctgaatcaggaacagagcgtggatcttcacattgagatcgagtcacaaggtattagtacgtccgtgcatgctctgggccactggtttgacgggcggttgaacctcaaaacctctttccattgttacggagcctgcactaagtacgaatatccttggcacacagcaaaatgtcactttgagcgagatttcgaatacgagaatagctggggctgcaacccagccgactgtcccggtatcgggaccggctgcacagcttgcggactgtatatagaccagttaaagcctgtcggctccgcctacaagctgatcactgttcgctattcaagaaaagtgtgtgtgcagtttggggaagagaacctatgcaagaccattgatatgaatgactgtttcgtaacgaggcatgtcaaagtgtgcatcattggaaccgttagcaagtttagtcagggtgatacactcgtgttcctgggcccaatggtcgggggaggccttatctttaaagactggtgtacttctacctgccaattcggtgatcccggggacataatgtccccgaaggataaaggctttagctgtcctgacttcacaggacactttcggaagaagtgcaacttcgcaactaccccagtgtgtgagtacgatggcaatatggtttcggggtataaaaaggtgatggctacgattgactcattccagtcttttaacacaagttccatccattacaccgatgaacgcatcgagtggaaagaccccgatggaatgttgaaggaccacctgaatattctcgtaactaaagacatcgatttcgaaaacctgggcgagaatccttgcaaggtcggtttacagacaagctctattgaaggggcctggggaagcggcgtgggttttaccctgacttgtcagatatcccttaccgagtgctcaagattcttgacaagtatcaaggcgtgcgacatggccatttgttacggcgctcaaagcgtgacgctcatcagggggcagaacaccgtcaaagtttctggaaagggcgggcattccggatcaagttttaaatgctgtcacggcactgattgcagccagcaaggtctgcaggcatccgctccccacctagacaaggtgaatgggattgtagagcaggattctgaaaaagtgtatgacgatggagccccacagtgtggcatctcgtgctggttcgtcaagagcggtgagtggataacaggcatctttaacgggaattggattgtgatcgttgtgctggtcttctttttcattctctcactgatccttttgtccctgttatgtcctatacgtaagcataaacggagttga

SEQ ID NO: 10020 - RNA, 3408 nt, synthetic construct
  misc_feature 1..3408: note = derived and/or modified CDS sequence (opt3) from DOBV(B13)__GU904034.1__GP
  source 1..3408: mol_type = other RNA
atgatcatgtggggcctgctccttaccatgattctgatagacttcggggccagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcaccctgtcccaccggatggtggaggaatcttatcgcaatcgacgtagcgttatctgttacgacttgtcctgcaactcaacacattgtaagcccaccatgcacatgatagtgcctgtccatagttgcaatatgatgaaaagctgtctcgtggggctgggaccatatagaatccaggtagtttacgagaggacttattgcacaaccggcattctgacggaaggtaagtgttttgtgcccgatcagtctatcgtctccgtgattaaaaacggggtgttcgacatcgcatcagtcagcatagtttgctttttcattcgggtgaagggaactaattacaagatcatggccagtattaaaaccgctacagcaaacaattgtaacgatactgacaataaggtacaaggctattacctctgcatcgtgggcgggaactcttcccctgtctacgccccaagcaccacagattttcgctcgatggaggctttagcctctctgcttagagcgccccacggagaggaccacgatttgtccggtgaagaggtggcaacctattcaatcgccggccagattgaagggaaaatacctcatacggctaatgccgcaaacatgctgttcactgcttttagtggaatcccaagctactcctctctaagcgttttcattggctcacaggacggtccgatcatatatagtcccgggctctttcctaagctgaaccagtccagctgcgacaaagtggcccttccactgatttgggagggatacatcgatttgcccggctattacgaaacagtccacccttgtaatgtgttctgcgtactctctggcccaggggcgtcatgtgaggcctttagtgagggaggtatcttcaacattaccagccccacttgcctggtttccaagcaaaataggttccgggcagctgaacaacaggtgaactttgtctgtcagcgcgtggaccaggatatcattatatattgcaatggccagaaaaagacaatcttaaccaagacgctggtcattgggcagtgtatctactctgtgaccagcctcttcagcatcatgccgggagttgcccattccattgctatagagctttgcgtgcctggctttcacggttgggccacagcagccctgttgactaccttctgttttgggtggatcctaattccctcaatcacactggctgtactcgtcgtgctgaaattctttgcggcaattcttcacaacagttctcaagaaaatcgattcaagatcatactgagaaaaatcaaggaggaatttgagaaaactaagggcagcatggtttgcgaggtgtgtaagtacgaatgcgagaccggaaaagaattgaaggcccataacctctcctgcccacagtcacagtgtccttattgcttcacacactgtgagcccaccgaaagcgcttttcaggcccattacaaagtctgccaagcaactcacaggttccgggacgatctgaagaaaacgattacaccacagtctacctcccccggctgttatcgtactttaaatctgtttcgctacaagagtagatgctatatcttcaccgtgtgggtaacactactcattatcgagagcataatgtgggccgcttctgcctccgagaacgtgctggaaccttcatggaatgacaacgcacatggggttggagtcgtgccaatgcacaccgatcttgagttggacttcagtctgccgagctcgtccaagtacacttataaaaggaagctcacatctcccctgaatcaggaacagagcgtggatcttcacattgagatcgagtcacaaggtattagtacgtccgtccatgcgctgggccactggtttgacgggcggttgaacctcaaaacctctttccattgttacggagcttgcactaagtacgaatatccttggcacacagccaaatgtcactttgagcgagatttcgaatacgagaatagctggggctgcaacccagcagactgtcccggtatcgggaccggctgcacagcctgcggactgtatatagaccagttaaagcctgttggctccgcttacaagctgatcactgtgcgctattcaagaaaagtgtgtgtacagtttggggaagagaacctatgcaagaccattgatatgaatgactgtttcgtcacgaggcatgtgaaagtttgcatcattggaaccgtgagcaagtttagtcagggtgatacactcgtcttcctgggcccaatggttgggggaggccttatctttaaagactggtgtacttctacctgccaattcggtgatcccggggacataatgtccccgaaggataaaggctttagctgtcctgacttcacaggacactttcggaagaagtgcaacttcgccactaccccagtgtgtgagtacgatggcaatatggtgtcggggtataaaaaggtaatggcaacgattgactcattccagtcttttaacacaagttccatccattacaccgatgaacgcatcgagtggaaagaccccgatggaatgttgaaggaccacctgaatattctcgtcactaaagacatcgatttcgaaaacctgggcgagaatccttgcaaggtgggtttacagacaagctctattgaaggggcttggggaagcggcgtgggttttaccctgacttgtcagatatcccttaccgagtgctcaagattcttgacaagtatcaaggcctgcgacatggcgatttgttacggcgcccaaagcgtcacgctcatcagggggcagaacaccgttaaagtgtctggaaagggcgggcattccggatcaagttttaaatgctgtcacggcactgattgcagccagcaaggtctgcaggcttccgcaccccacctagacaaggtaaatgggattgtggagcaggattctgaaaaagtctatgacgatggagccccacagtgtggcatctcgtgctggttcgtgaagtcgggtgagtggataacaggcatctttaacgggaattggattgttatcgtggtcctggtgttctttttcattctctcactgatccttttgtccctgttatgtcctatacgtaagcataaacggagttga

SEQ ID NO: 10021 - RNA, 3408 nt, synthetic construct
  misc_feature 1..3408: note = derived and/or modified CDS sequence (opt3) from DOBV(Aa1854/Lipetsk-02)__EU188453.1__GP
  source 1..3408: mol_type = other RNA
atgatcatgtggggcctgctccttaccatggccctgattaaccccggggctacattgagaaatgtgtacgacatgaggatagagtgccctcacagcatcaacttcggagaatcctctgtcactggtaaggttgagttaccaccgattcccctggcagatgccgaaacgctagtgcctgagtcaagttgtaatatggacaaccatcagagcctctccatcacccaaaaagtaacaaaggtgtcttggcggaaaaaggcggataaagtccaggctgccaaggactcgtttgaaactacctcaagcgagattaatctgaagggcacatgcacccttactcaccgcatggtggaggaaagttatcgaaaccgtaaatccgttatctgttacgatctgtcttgcaatagcacacattgtaagccaaccatgcacatgatagtgcccgtccattcctgcaacatgatgaaatcatgtttggtggggctcggaccttatagaatccaggtagtttacgagaggacgtattgcactaccggcattctgacagaaggtaagtgtttcgtgccagaccagagtatcgtcagcgtgattaaaaatggggtgtttgatatcgcatctgtctccatagtttgcttctttattcggatcaagggaaactcatacaagattatggccagcatcaaagaggctaatcccaacaattgtaacgacactgataataaggtgcaaggctattacctgtgcatcgtaggcgcaaacagttctcctgtgtacgccccatccaccacagacttccgcagcgtcgaggctctcgcctcgttactgagatctccgcacggggaagatcacgacctttccggagaggaagtggcgacctattcaattgcaggtcaggttgagggcaaagtgccccatacggccaacgctgccaatatgttgtttactgcattcagtgggatacctagccactcctcttttagcgtcttcacaggaaaccaggatggcaccgtgatctactcaccaggtctgtttcccaagctaaatcagagtgcttgcgacaaagtagccctccctctgatttgggaagggtatatcgaccttccaggatactatgagactatacatccctgtaacgttttctgcgtgctgtccggcccgggcgcgagctgtgaggccttttctgaagggggaattttcaatatcacatcacctacctgcttggtcagtaagcaaaacaggttccgggcagctgagcagcagatcaattttgtgtgtcagcgcgtcgatcaagacattgtgatctactgcaacggtcagaaaaagacgattctcaccaagacactggttataggccagtgtatctatagcgtgacttccttattctctattatgcccggggtagcccactcgatcgctatcgaactgtgcgtcccaggatttcacggctgggccaccgcagccctccttacaactttctgttttggttggattctgatacctagcatcaccttggctattctaatcgtgctgaaattctttgcggcaattctccataattcctcacaagagaaccgattcaagatcatactgagaaaaatcaaggaagagtttgagaggacaaaagggagtatggtttgcgaagtgtgtaagtacgagtgcgaaaccggcaaggagcttaaagcccacaatctgtcttgcccccagagccagtgtccatactgcttcactcattgtgaattgacggagtccgcttttcaggcccactatcgggtctgccaagcaacacatcgtttccgcgatgacctcaagaaaaccattactccccagtcaaccagccctggatgttacagaacactgaacttatttaggtataagtctcggtgctacatcttcaccgtgtgggtagtgctgctaattatcgagtccatactctgggccgctagtgccagcgaaactgttctggagccaaattggaacgataatgcacacggcgtcggggtggtgccgatgcacacagaccttgaattggatttctctctgccctcctcaagtaaatatacgtacaagcgaaagctcaccagccctattaaccaggagcagtcggtcgacctgcatatcgaggttgaatcccaaggaatttctactagcgtgcacgcgcttggtcattggtttgatggccgcctgaacttgaaaacatcattccactgttatggggcttgcaccaagtacgagtacccatggcacacagccagatgtcattttgaaagggacttcgagtatgaaaatagttggtcctgcaaccccgcagattgtcctggaatcggcactggttgcaccgcctgcgggctctacctggaccagttaaaaccagtgggctctgcttataagctgataacggtacggtacagccgcagagtctgtgtgcagtttggagaggagaatctatgcaaaaccatcgacatgaacgattgtttcgttacaaggcacgtgaaggtctgcattatcggcactgtgtccaagttttcacagggggacaccctcgttttcctgggacccatggaaggtggcgggcttatttttaaagattggtgtacaactacctgccaattcggagacccgggcgatatcatgagccctaaggacaaaggttttagttgtccagatttcacggggcattttcgtaagaaatgcaatttcgccacaacccccgtgtgtgagtatgacggcaacatggtatctggatacaagaaagtcatggcaactatagattccttccaggcttttaatacaagcaacattcactataccgacgaacggatcgagtggaaggatcctgacggcatgttgaaggatcatctgaatatcctcgtgactaaagacattgacttcgaaaacctgggggagaatccctgcaaggtgggattacagaccgcctcgatcgagggcgcgtggggttcaggggtcggatttacactgacgtgtcagatttctcttaccgaatgcagtcgattcttgacttccataaaagcctgcgatatggctatctgttacggcgcacaaagcgttacactcgtgagaggtcagaacaccgtaaaggtgtctggcaaagggggacacagcggctcctcatttaagtgctgtcacgggacagactgcagtcagcaaggactgcaggccagcgctccacatctagataaggtcaatggcattgtggagcaggaatctactcaggtttacgacgatggtgcccctcaatgtgggatctcctgctggttcattaaatcaggagagtggatcaagggcatatttaacggtaattggatcgtgattgtcgtgctgatcttctttttcattctcagtctgatccttttgagctttctgtgtcccataaggaaacacaagcgctcctga

SEQ ID NO: 10022 - RNA, 3402 nt, synthetic construct
  misc_feature 1..3402: note = derived and/or modified CDS sequence (opt3) from DOBV(Ap/Sochi/hu)__JF920149.1__GP
  source 1..3402: mol_type = other RNA
atgtggggcctgctccttaccatgatcctgattgacttcggggccacattgagaaacgtgtacgatatgaggatagagtgcccccacagcgtcaattttggagaatcctctgtttcaggtaaggtggagttacctccagtactgctaagtgaagtggagactctcgtcccggaaagctcctgtaacatggacaatcatcagtctatgtcgatcattcaaaaagtgacgcagctgacctggcggaagaaagccgataaggcacaggccgcgaaagactcattcgagatcacaagcggcgaggttagtcttaaggggacttgcaccctgacacaccgcatggtggaagattcccatcgaaaccgtaagtctattatctgttatgacttgagctgcaattccacccactgtaaacccactatgcatatgatagtccctatccactcatgcaacatgatgaagagttgtctcgtgggactgggcccatacaggattcaggtagtttatgagagaacatactgcaccacgggtatcctgactgaagggaaatgttttgtgcccgatcaaagcattgtcaatgtgatcaagaacggagtgttcgacatagcttctgtctccattgtttgctttttcgtgcgggtaaaaggcaccaattataagatcatggcctcaattaagacagcaactagcaacaattgtaacgataccggcaataaagtgcaggggtactatctctgcatcgtcggaggtaacagttctcctgtgtacgttccatccacaaccgactttcgcagcatggaggccttagcttcgatgctgagagcaccccacggcgaggatcatgaccttgccggggaagaggtggctacgtactctatcgccggacaggtcgaaggcaaggtgcctcacactgcgtccacagcaaatatgttgctgaccgccttctcaggtattccaagttatagctccctatctgtatttactgggagccaggatggaccgatagtttactcacccggcctcttccctaaactgaaccaaagttcctgcgacaaggtgggccttccactgatctgggaggggtatattgacttgcccggatactatgaaacagtccatcagtgtaacgtgttttgcgtcctcagcggtcctggcgcttcttgtgaggccttctcagaagggggaatctttaatataaccagtccaaactgcatggtgagcaaacagaataggttccgggcagctgaacagcaagttaacttcgcctgtcagcgcgtggatcaggacattctgatcttttgcaatggccaaaagaaaacgatcttaaccaagacactggtaattggtcagtgtatctactccattacttctctcttctcgataatgcccggggtcgcgcacagcatcgccattgagctttgcgtgccgggctttcacggatgggcaaccgctgccctgttgacaactttctgttttggctgggttctaatcccttccatcaccctggctgtgctcgtcgtgctgaagttctttgccgcaattcttcataactcaagtcaggaaaatcgattcaaactgatattgaagaaaatcaaggaggaatttgagaaaacaaaggggtctatggtatgcgaggtgtgtaagtatgaatgcgagaccggaaaagaactcaaggcccacaacctgagctgcccccagtcccaatgtccatactgcttcactcattgtgagcctacggaatcagcttttcaggcgcactacaaagtttgccaggcaacacatagattcagggatgacttaaagaaaaccattactccccagagcacctctccaggttgttatcggacactgaatctatttcgttacaagtcccgctgctatatcttcaccgtctgggtggtgctcctggtcgttgagagtgtgatgtgggccgctagcgcctctgagactgtgcttgaaccctcctggaacgataatgcacacggcgtaggggtcgtgcctatgcacacagacttggagctggatttctcactcccaagtagctcgaagtacacgtataaaagaaagctgacctccccgattaaccaagaacagtctgttgaccttcatatcgagatagagagccagggaatctcaacaagtgtgcacgccctgggccattggtttgatggtaggttgaatctcaaaacttccttccactgttacggggcttgcaccaagtatgaatacccctggcacacagcccggtgtcattttgagcgagacttcgaatacgagaactcttggggctgcaatcctgcagattgtccaggaattggcactgggtgcaccgcgtgcggaatctatattgaccagctgaaacccgtcggtagcgcttacaagttaatcacggtgcgctattccagaaaggtttgtgtgcaatttggcgaagagaacctgtgcaaaaccatagacatgaacgattgtttcgtaacaaggcacgtcaaggtgtgcattatcgggactgtgtcaaaatttagccagggagacaccctagtcttcctcggccctatggagggtgggggcctgatttttaaggattggtgtacaagtacttgccagttcggagacccaggcgatatcatgtctcccaaagacaaggggttttcctgtccggagttcaccggacattttcggaaaaagtgcaatttcgccacgacacctgtttgtgagtacgatggcaacatggtgagcggttataagaaagtaatggcaaccatagactcgttccaggcctttaatacttcatctatccactacacagatgaacgcattgagtggaaggacccagatgggatgcttaaagaccatttgaacatcctggtgaccaaggatattgacttcgaaaatctcggagacaacccctgcaaagtcggcctgcaaactgtgagtatcgagggtgcttggggctccggggttggatttaccttaacatgtcaggtgagcctgacggagtgctctagattccttaccagcataaaggcctgcgataaggcaatttgttatggcgctcagtcctcaactttgatcagggggcaaaatacagtcaaagtgagtggaaagggcggtcacagcgggtcttcctttaaatgctgtcacggaaccgactgctcacagcagggcctccaggccagtgcgcctcatctggataagatcaacggtattgttgaacaagagaatgaaaaagtgtacgacgatggcgctccccagtgtgggatcagctgctggttcgtcaagtccggagagtggattcagggcatatttaacgggaattggatcgtaattgtggttctaatcttctttttcattctgtctctcatcctgctttcgatattttgtccaatccgtaagcacaaacggagctga

SEQ ID NO: 10023 - RNA, 3402 nt, synthetic construct
  misc_feature 1..3402: note = derived and/or modified CDS sequence (opt3) from DOBV(Ap1584/Sochi-01)__EU188450.1__GP
  source 1..3402: mol_type = other RNA
atgtggggcctgctccttaccatgatcctgattgacttcggggccacattgagaaacgtgtacgatatgaggatagagtgcccccacagcgtcaattttggagaatcctctgtttcaggtaaggtggagttacctccagtactgctaagtgaagtggagactctcgtcccggaaagctcctgtaacatggacaatcatcagtctatgtcgatcattcaaaaagtgacgcagctgacctggcggaagaaagctgataaggcacaggccgcgaaagactcattcgagatcacaagcggcgaggttagtcttaaggggacttgcaccctgacacaccgcatggtggaagattcccatcgaaaccgtaagtctattatctgttatgacttgagctgcaattccacccactgtaaacccactatgcatatgatagtccctatccactcatgcaacatgatgaagagttgtctcgtgggactgggcccatacaggattcaggtagtttatgagagaacatactgcaccacgggtatcctgactgaagggaaatgttttgtgcccgatcaaagcattgtcaatgtgatcaagaacggagtgttcgacatagcttctgtctccattgtttgctttttcgtgcgggtaaaaggcaccaattataagatcatggcctcaattaagacagcaactagcaacaattgtaacgataccggcaataaagtgcaggggtactatctctgcatcgtcggaggtaacagttctcctgtgtacgttccatccacaaccgactttcgcagcatggaggccttagcttcgatgctgagagcaccccacggcgaggatcatgaccttgccggggaagaggtggctacgtactctatcgccggacaggtcgaaggcaaggtgcctcacactgcgaatgcagccaacatgttgctgacagctttctccggtgtaccatcatatagtagcctatccgtttttaccgggtctcaggatggaccgattgtgtacagccccggcctcttccctaaactgaaccaatcaagttgcgacaaggtcggccttccactgatatgggaggggtatatcgacttgcccggatactatgaaactgtgcatcagtgtaatgtcttttgcgtgctctccggtcctggcgccagctgtgaggcattctctgaagggggaatttttaacatcacatcaccaaattgcatggttagtaaacagaacaggttccgggctgccgaacagcaagtgaatttcgcgtgtcagagcgtagatcaggacatactgatcttttgcaacggccaaaagaaaaccattttaacgaagaccctggtcatcggtcagtgtatttaccccatcacatccctcttctctattatgccgggggtggcccactcgatagcaatcgagctttgcgttcctggctttcacggatgggctactgccgctctgttgaccacattctgttttggctgggtgctaattcccagcatcactctggccgtcctcgtggtactgaagttctttgcagccatccttcataattcctcacaggaaaaccgcttcaaactgattttgaagaaaataaaggaggaatttgagaaaaccaaggggagtatggtgtgcgaggtttgtaagtatgaatgcgagacaggaaaagaactcaaggctcacaatctgtcttgcccacagagccaatgtccttactgcttcacccattgtgagcccactgaatccgcgtttcaggcacactacaaagtctgccaggccacgcatcgattcagagatgacttaaagaaaacaatcaccccacagtcaactagccccggttgttataggaccctgaacctatttcggtacaagtctcgttgctatattttcacagtgtgggtggtcctcctggttgtggagtccgtgatgtgggctgccagtgcaagcgagaccgtacttgaaccttcttggaatgataacgcccacggcgtcggggtggttccaatgcacactgacttggagctggatttctccctcccgtcaagtagcaagtacacatataaacgcaagctgacgtcgcccatcaatcaagaacagtccgtggaccttcatattgagatcgagtctcagggaataagcacctcagtccacgctctgggccattggtttgatggtagattgaacctcaaaacttccttccactgttacggggcctgcacaaagtatgaatacccttggcacaccgcaaggtgtcattttgagcgggacttcgaatacgagaatagttggggctgcaacccagcggattgtcccggaatcggcacagggtgcactgcttgcggaatttatatcgaccagctgaaacctgtgggttctgcctacaagttaattaccgttcgatatagccgcaaggtgtgtgtacaatttggcgaagagaacctgtgcaaaacgatcgacatgaatgattgtttcgtcaccagacacgtgaaggtgtgcataattgggacagtctccaaattttcacagggagacactctagttttcctcggcccaatggagggtgggggcctgatctttaaggattggtgtaccagcacatgccagttcggagaccccggcgatattatgagtccgaaagacaaggggttttcttgtcctgagttcactggacattttaggaaaaagtgcaacttcgcaaccacgccagtgtgtgagtacgatggcaatatggtatccggttataagaaagtgatggccacaatcgacagcttccaggcttttaacacctcgtcaatacactacactgatgaacggatcgagtggaaggaccccgatgggatgcttaaagaccatttgaatattctggtcacaaaggatatcgacttcgaaaacctcggagactctccttgcaaagtgggcctgcaaaccgttagtattgagggtgcctggggctccggggtgggatttactttaacctgtcaggtcagcctgacagagtgctctcgcttccttacgagcatcaaggcatgcgataaggctatatgttatggcgcccagtcctcaaccttgattagagggcaaaatactgtgaaagttagtggaaagggcggtcacagcgggtcttcctttaaatgctgtcacggaacagactgctcacagcagggcctccaggcgagtgctccccatctggataagatcaacggtatcgtggaacaagagaatgaaaaagtctacgacgatggcgccccacagtgtgggattagctgctggttcgtaaagtccggagagtggatccagggcatttttaacgggaattggatagtgatcgttgtgctaattttctttttcatcctgtctctcattctgctttcgatcttttgtcctataaggaagcacaaacgtagctga

SEQ ID NO: 10024 - RNA, 3408 nt, synthetic construct
  misc_feature 1..3408: note = derived and/or modified CDS sequence (opt3) from DOBV(GER/05/477/Af)__GQ205411.1__GP
  source 1..3408: mol_type = other RNA
atgatcatgtggggcctgctccttaccctgagcttgattaacttaggggcctccctgagaaatgtgtacgacatgaagatagagtgcccccactctatcaacttcggagaatcaagtgtcacaggtaaagttgagctacctccactcctgcttactgatgccgaagcactggtgccggagagctcctgtaatatggacaaccatcagtctttgtcgattacgcaaaaggtaaccaaagtgtcatggaggaagaaagccgataaggtccaggcggctaaggacagctttgaaacaaccagttccgaggtgaatttcaaagggacctgcacactcacccaccggatggttgaggaatcttatcgcaaccgaaagagcgtgatctgttacgatctgtcctgcaattcaactcattgtaaacccacaatgcacatgattgtccctgtgcatagttgcaacatgatgaaaagctgtctggtagggctcggaccatatcgtatccaggttgtgtacgagagaacctattgcacgactggcatattaaccgaaggtaaatgttttgtccccgaccagtctatcatttccgtgctgaagaatggggtgttcgatatcgcctcagtcagcattgtttgctttttcatcaggataaagggaacaagttacaaaattatgacttctatcaaggaggcaaaccctaataactgtaatgacaccgataacaaagtgcaaggctattacctttgcattgtaggcgccaattccagcccagtgtacgctccctcgacaaccgactttcggtctgtcgaggcattggcctccctgctacgctcacctcacggggaagatcacgacctcgctggagaggaagtggccacgtatagtatcgcgggtcaggttgagggcaaggtgccacatactgcaaacgccgctaacatgctgttcacagcctttagcgggatcccgtcctactctagcttctcagtctttaccggaaatcaggaaggcaacgtgatttatagtcccggtcttttccctaaactgaatcagtccagctgcgagaaggtagcattgccactcatatgggaggggtacatcgatctgcccggatattacgaaactgttcacccttgtaacgtgttttgcgtcttatctggcccaggcgcttcatgtgaggccttcagtgaagggggaattttcaatatcacaagccccacttgcctggtgtccaaacaaaacagatttagggcggccgagcagcagataaatttcgtctgtcagcgggtggaccaagacattgttatctattgcaacggtcagaagaagacgatcctcaccaaaacacttgtgattggccagtgtatctactctgtaacttcgctgtttagcattatgccgggggtcgcacattccatagctatcgaattgtgcgtgcctggattccacggctgggccaccgctgccctactgacaactttttgtttcggttggattctcatcccctcaatcaccctggcaattcttataatcctgaagtttttcgccgctttgtttcacaatagttctcaagagaaccgcttcaaaattatcctcaagaaaattaaggaggaatttgagaagacaaaagggagcatggtttgcgaagtgtgtaagtacgagtgcgaaaccggcaaagagctgaaggcgcataatttatcctgcccacagtcacagtgtccttattgcttcactcactgtgagctgacggaaagcgcatttcaggcccattaccgagtctgccaagctacacacagattcagggatgacctaaagaagaccatcactccccagtctacctccccaggatgttatcggacactcaacctgttccgttacaagagtcgctgctatatatttaccgtgtgggtaatccttttgattatcgagagcattctgtgggccgcatctgcctccgaaactgtgctcgagccctcatggaatgataacgctcatggcgttggggtcgtgcctatgcacacagacctggagcttgatttcagtctgccaagctcgtccaaatacacgtataagagaaaattgacctctccgatcaatcaggaacagagcgtggacctccacatagagattgaatcacaaggaatcagtacttccgtccatgccctgggtcactggtttgatggcaggttaaacctgaagacatctttccattgttacggggcatgcaccaaatacgagtatccctggcacacagcgaagtgtcactttgaacgggacttcgagtacgagaacagctggtcctgcaatcctgctgattgtccaggaattggcactggttgcaccgcctgcgggctatatctcgaccagctgaagcccgttggctcagcatacaaacttatcacggtgcgatatagccgcaaggtgtgtgtacagtttggagaagagaacttgtgcaaaaccatagatatgaatgactgtttcgtcacaagacatgtgaaggtttgcatcattggcactgtgagtaaattttctcagggggacaccctggtcttcctcggacctatggaaggtggcgggctgatctttaaggattggtgtacaactacctgccaattcggagacccaggcgatattatgtcccccaaagacaagggttttagctgtccggatttcacggggcacttcaggaagaaatgcaactttgccacaacccctgtgtgtgagtacgacggcaatatggtttcgggatataagaaagtgatggctactatcgattcattccaggcctttaacacatctaatatacattacaccgacgaacggattgagtggaaggatccagacggcatgttaaaagatcacctgaacatccttgtaactaaggacatcgatttcgagaatttgggggaaaacccctgcaaggtcggactccagaccgcaagtattgacggcgcttggggttccggggtgggatttacactgacgtgtcagatcagcctaaccgagtgctctcgcttcctgactagcattaaagcctgcgacatggcgatatgttacggcgcccaatccgtgacactcgtcagaggtcagaataccgttagggtgtcaggcaagggcggacatagtggcagctcttttaaatgctgtcacgggacagattgctcccagcaaggactgcaggcttcagcacctcaccttgacaaggtaaacggcatcgtggaacaggagagtactcaggtctatgatgacggtgctccccaatgtgggattagctgctggttcgtgaaatccggagaatggatcaagggcatttttaatggtaactggatcgttatagtggtcttgatcttcctgtttttactctctctgattcttctgtcgttcttgtgtccaatccgtaagcataaacggagctga

SEQ ID NO: 10025 - RNA, 3408 nt, synthetic construct
  misc_feature 1..3408: note = derived and/or modified CDS sequence (opt3) from DOBV(GER/07/607/Af)__GQ205410.1__GP
  source 1..3408: mol_type = other RNA
atgatcatgtggggcctgctcgtgacccttagcctgattaacttgggggcctccttaagaaatgtctacgacatgaagatagagtgcccccactctatcaacttcggagaatcaagtgttacaggtaaagtggagctgcctccactaccgctcactgatgctgaaacgctggtacccgagagctcctgtaatatggacaaccatcagtctctttcgattacccaaaaggtgacaaaagtctcatggaggaagaaagcagataaggtgcaggccgcgaaggacagctttgaaactaccagttccgagatgaatctgaaaggcacatgcaccttgactcaccggatggttgaggaatcttatcgcaaccgaaagagcgtgatctgttacgatctctcctgcaattcaacacattgtaaacctaccatgcacatgattgtcccagtgcatagttgcaacatgatgaagtcgtgtctggtagggctgggaccctatcgtatccaggttgtgtacgagagaacgtattgcactaccggcatactcacagaaggtaaatgtttcgtccctgaccagtctatcatttccgtgatgaagaatggggtgtttgatatcgcttcagtcagcattgtttgcttctttatcaggataaagggaacgagttacaaaattatgacctctatcaaggaggccaacccaaataactgtaatgacacagataccaaagtgcaaggctattacttatgcattgtaggcgcaaactccagccccgtgtacgccccttcgacgactgacttccggtctgtcgaggctctggcatcccttttgcgctcaccacacggggaagatcacgacctggccggagaggaagtggctacatatagtatcgccggtcaggttgagggcaaggtgccgcataccgcgaatgcagccaacatgctatttactgctttcagcgggatcccctcctactctagcttttcagtcttcacaggaaaccaggatggcaccgtgatttatagtcctggtctctttccaaaactgaatcagtccagctgcgacaaggtagcccttcccctgatatgggaagggtacatcgacttgcctggatattacgagacggttcacccatgtaacgtgttctgcgtcctctctggccccggcgcatcatgtgaggcttttagtgaagggggaattttcaatatcaccagcccgacatgcctggtgtccaaacaaaacagattcagggccgcggagcagcagataaattttgtctgtcagcgggtggatcaagacattgttatctattgcaacggtcagaagaagactatcttaaccaaaacactggtgattggccagtgtatctactctgtaactagcctcttcagcattatgcctggggtcgcccattccatagcaatcgaactttgcgtgcccggatttcacggctgggctaccgccgctctgttgacaaccttctgttttggttggattctaatcccatcaatcactctggccattctcatagttctgaagttctttgcagcccttctgcacaatagttctcaagagaaccgcttcaaaatcattttgaagaaaatcaaggaagagtttgagaagacgaaagggagcatggtgtgcgaagtctgtaagtacgagtgcgaaacaggcaaagagctcaaggctcataatctgtcctgccctcagtcacagtgtccctattgcttcacccactgtgaattaactgagagcgcgtttcaggcacattaccgagtgtgccaagccacccacagattcagggatgacctgaaaaagacaattaccccacagtctacttcccccggatgttatcggacactaaacctctttcgttacaagagtcgctgctatatcttcacggtatgggtgatactgcttatcattgagagcatcttgtgggctgcctctgcatccgaaaccgttctggagccttcatggaatgataacgcccatggcgtcggggtggtgccaatgcacgctgacctcgaactggatttcagtcttccgagctcgtccaaatacacttataagagaaaactgacatctcccattaatcaggagcagagcgtcgacttgcacatcgagatagaatcacaaggaattagtacctccgttcatgccctcggtcactggtttgatggcaggctgaacttaaagacatctttccattgttacggggcatgcactaaatacgagtatccttggcacaccgcgaagtgtcactttgaacgggacttcgagtacgaaaatagctggtcctgcaacccagctgattgtcccggaatcggcacgggttgcaccgcctgcgggctgtatctagaccagctcaagcctgtgggctcagcatacaaactgattacagtgcgatatagccgcaaggtatgtgtccagtttggagaggagaacctttgcaaaactatcgacatgaatgattgtttcgtgaccagacatgttaaggtgtgcataatcggcacagtcagtaaattttctcagggggacactttggtgttcctgggaccaatggaaggtggcgggctcatttttaaggattggtgtaccacgacatgccaattcggagaccccggcgatatcatgtccccgaaagacaagggttttagctgtcctgatttcaccgggcactttaggaagaaatgcaacttcgccactacaccagtttgtgagtacgacggcaatatggtgtcgggatataagaaagtaatggctaccattgattcattccaggcctttaacacttctaatatccattacaccgacgaacggatagagtggaaggatcccgacggcatgctgaaagatcacttaaacattctggtcacaaaggacatcgacttcgaaaatcttggggagaacccttgcaaggtgggattgcagacggcaagtatcgatggcgcttggggttccggggtgggatttaccctcacttgtcagattagcctgacagagtgctctcgcttcctaaccagcatcaaagcctgcgacatggcgatttgttacggcgcccaatccgtcacactggttagaggtcagaatactgtgaaggtatcaggcaaagggggacatagtggcagctcttttaagtgctgtcacgggaccgattgctcccagcaaggactccaggcttcagcaccccacctggacaaagtgaacggcatagtcgaacaggagagtactcaggtgtatgatgacggtgccccacaatgtgggatcagctgctggttcgttaagtccggagaatggattaagggcatcttttctggtaattggattgtgatcgtcgtgcttatattcttgtttctgttatcgctcatcctgcttagcttcctgtgtcctattaggaaacataagcgttcatga

SEQ ID NO: 10026 - RNA, 3408 nt, synthetic construct
  misc_feature 1..3408: note = derived and/or modified CDS sequence (opt3) from DOBV(GER/08/118/Aa)__GQ205412.1__GP
  source 1..3408: mol_type = other RNA
atgatcatgtggggcctgctcgtgattcttagcctgataaacttgggggcctccttaagaaatgtctacgacatgaagatcgagtgcccccactctattaacttcggagaatcaagtgttaccggtaaagtggagctgcctccactaccgctcacagatgctgaaactctggtacccgagagctcctgtaatatggacaaccatcagtctctttcgatcacgcaaaaggtgaccaaagtctcatggaggaagaaagcagataaggtgcaggccgcgaaggacagctttgaaacaactagctccgagattaatctgaaagggacctgcacattgacccaccggatggttgaggaatcttatcgcaaccgaaagagcgtgatctgttacgatctctcctgcaattcaactcattgtaaacctacaatgcacatgatagtcccagtgcatagttgcaacatgatgaagagttgtctggtagggctgggaccctatcgtatccaggttgtgtacgagagaacctattgcacgactggcattctcaccgaaggtaaatgtttcgtccctgaccagtctatcatttccgtgatgaagaatggggtgtttgatatcgcttcagtcagcatagtttgcttctttattaggatcaagggaacaagttacaaaattatgacttctatcaaggaggccaacccaaataactgtaatgacaccgataacaaagtgcaaggctattacttatgcatcgtaggcgcaaattccagccccgtgtacgccccttcgacaaccgacttccggtctgtcgaggctctggcatcccttttgcgctcaccacacggggaagatcacgacctggccggagaggaagtggctacgtatagtattgccggtcaggttgatggcaaggtgccgcatactgcgaacgcagccaacatgctatttacagctttcagcgggataccctcctactctagcttttcagtcttcaccggaaatcaggacggcactgtgatctatagtcctggtctctttccaaaactgaaccagtccagctgcgacaaggtagcccttcccctgatttgggaggggtacatcgatttgcctggatattacgaaacagttcacccatgtaatgtgttctgcgtcctctctggccccggcgcatcatgtgaggcttttagtgagggcggaatattcaacattaccagcccgacgtgcctggtgtccaaacaaaatagattcagggccgcggaacagcagatcaactttgtctgtcagcgggtggaccaagatatcgttatttattgcaatggtcagaagaagaccatcttaacaaaaactctggtgattggccagtgtatatactctgtaacctcgctctttagcatcatgcctggggtcgcccattccattgcaatcgagctttgcgtgcccggatttcacggctgggctacagccgctctgttgactaccttctgttttggttggatcctaattccatcaataacactggccatcctcattgttctgaagttctttgcagcccttctgcacaacagttctcaagaaaatcgcttcaaaatcattttgaagaaaatcaaggaggaatttgagaagaccaaagggagcatggtgtgcgaggtctgtaagtacgaatgcgagactggcaaagaactcaaggctcataacctgtcctgccctcagtcacagtgtccctattgcttcacgcactgtgagttaacagaaagcgcgtttcaggcacattaccgagtgtgccaagccacccacagattcagggacgatctgaaaaagactataaccccacagtctacatcccccggatgttatcggaccctaaatctctttcgttacaagagtcgctgctatatcttcactgtatgggtgattctgcttatcattgagagcatcttgtgggctgcctctgcatccgagacaatactggaaccttcatggaacgacaatgcccatggcgttggggtcgtgccaatgcacacggatctcgagctggacttcagtcttccgagctcgtccaaatacacctataagagaaaactgacttctcccattaaccaggaacagagcgtggatttgcacatcgagattgagtcacaaggaatcagtacatccgtccatgctctcggtcactggtttgacggcaggctgaatttaaagacctctttccattgttacggggcctgcacaaaatacgaatatccttggcacactgcaaagtgtcactttgagcgggatttcgaatacgagaacagctggtcctgcaacccagcggactgtcccggaataggcaccggttgcacggcttgcgggctgtatctagaccagctcaagcctgttggctcagcctacaaactgatcaccgtgcgatatagccgcaaggtgtgtgtacagtttggagaagagaatctttgcaaaacaattgatatgaacgactgtttcgtcactagacatgtgaaggtttgcatcattggcaccgtgagtaaattttctcagggggatacattggtcttcctgggaccaatggagggtggcgggctcatctttaaggactggtgtactaccacgtgccaattcggagatcccggcgacataatgtccccgaaagataagggttttagctgtcctgacttcacagggcactttaggaagaaatgcaatttcgcaaccactccagtgtgtgaatacgatggcaacatggtttcgggatataagaaagtgatggccacaattgactcattccaggcttttaatacctctaacatccattacactgatgagcggatcgaatgggaggaccccgatggcatgctgaaggaccacttaaatattctggtaaccaaagacatcgatttcgaaaaccttggggagaatccttgcaaggtcggattgcagacagccagtattgacggcgcatggggttccggggtgggatttacgctcacctgtcagataagcctgactgagtgctctcgcttcctaacaagcatcaaggcttgcgatatggccatttgttacggcgcgcaatccgtgaccctggtcagaggtcagaacacagttaaagtgtcaggcaaagggggacatagtggcagctcttttaagtgctgtcacgggactgactgctcccagcaaggactccaggcctcagctccccacctggataaggtaaatggcatcgtggaacaggagagtacccaggtctatgacgatggtgcaccacaatgtgggattagctgctggttcgtgaaatccggagaatggatcaagggcgttttctctggtaactggatagtgatcgtcgtgcttattttcttgtttctgttatcgctcatcctgcttagcttcctgtgtcctattaggaagcataaacgttcatga

SEQ ID NO: 10027 - RNA, 3408 nt, synthetic construct
  misc_feature 1..3408: note = derived and/or modified CDS sequence (opt3) from DOBV(GER/08/131/Af)__GQ205413.1__GP
  source 1..3408: mol_type = other RNA
atgatcatgtggggcctgctccttaccctgagcttgattaacttaggggcctccctgagaaatgtgtacgacatgaagatagagtgcccccactctatcaacttcggagaatcaagtgtcacaggtaaagttgagctacctccactcctgcttactgatgctgaaacgctggtgccggagagctcctgtaatatggacaaccatcagtctttgtcgattacccaaaaggtaacaaaagtgtcatggaggaagaaagcagataaggtccaggccgcgaaggacagctttgaaactaccagttccgaggtgaatctcaaaggcacatgcaccctgactcaccggatggttgaggaatcttatcgcagccgaaagtccgtgatctgttacgatctgtcatgcaacagtacacattgtaaacccaccatgcacatgattgtccctgtgcatagctgcaatatgatgaagtcttgtctcgtagggttaggaccatatcgtatccaggttgtgtacgagagaacgtattgcactaccggcatactgacagaaggtaaatgtttcgtccccgaccagtccatcatttcagtgatcaagaacggggtgtttgatattgctagcgtcagtatcgtttgcttctttataaggattaagggaacttcttacaaaatcatgacctccattaaggagagcaatcctaacaattgtaacgacacagataataaagtgcaaggctattacctttgcatcgtaggcgccaactcgtctccagtgtacgcaccctccaccacggacttccggtcagtcgaggccttggctagtctgctacgcagcccttatggggaagatcacgacctcgcaggagaggaagtggccacttactccatcgctggtcaggttgagggcaaggtgccacacacagccaatgcggcaaacatgctgtttaccgccttctctgggattccgagctattcaagtttttccgtcttcactggaaaccaggatggcaatgtgatatacagccccggtctttttcctaaactgaaccagtcttcatgcgaaaaggtagctttgccactcatctgggaggggtatattgacctgcccggatactatgagacagttcatccttgtaatgtgttctgcgtcttaagtggcccaggcgccagctgtgaagcattttccgaagggggaatcttcaacataacctctcccacgtgcctggtgtcgaaacaaaatagattcagggctgccgagcagcagattaactttgtctgtcagcgggtggaccaagatatcgttatctactgcaatggtcagaagaagaccattctcacaaaaactcttgtgatcggccagtgtatttacagcgtaacctccctgttctcaataatgccgggggtcgcgcacagtatcgccattgagttgtgcgtgcctggatttcatggctgggcaacagctgccctactgactaccttctgttttggttggatcctcatcccctctattacactggctatacttatcgttctgaagttctttgccgcattgctccacaacagctcccaagaaaatcgcttcaaaattatcctgaagaaaattaaggaggagtttgaaaagaccaaagggtcaatggtgtgcgaggtctgtaagtatgaatgcgagactggcaaagaattaaaggcccacaacctgagctgcccacagtctcagtgtccttactgcttcacgcattgtgagctaacagagtccgcttttcaggcgcactatcgagtgtgccaagcaacccatagattcagggacgatctcaaaaagactatcacaccccagagtaccagcccaggatgttaccggaccctgaatctttttcgttataagtctcgctgctacatattcactgtatgggtgatcttgctgattatcgaatccattctctgggccgcttcagccagtgagatcgttctggaacccagctggaacgacaatgcacacggcgtcggggtggtgcctatgcatacagatcttgagctggacttctcgttgccatcctctagcaaatatacgtacaagagaaaactcacctcaccgataaaccaggagcagagtgtcgatctgcacattgaaatcgagtcccaaggaatttctactagcgttcacgccttaggtcattggtttgacggcaggctgaatctaaagacatccttccactgttacggggcttgcaccaaatatgaatacccctggcatacagccaagtgtcactttgagcgggatttcgaatatgagaactcatggagctgcaaccctgcagactgtccaggaatcggcactggttgcaccgcgtgcgggctctacctggatcagcttaagcccgtgggcagtgcttataaattgataacggtgcgatactctcgcaaggtatgtgtccagtttggagaggaaaatctgtgcaaaaccatcgacatgaacgactgtttcgtgacaagacacgttaaggtgtgcattatcggcactgtctccaaatttagccagggggataccctcgtgttcctgggacctatggagggtggcgggttaatttttaaggactggtgtacaactacctgccaattcggagatccaggcgacatcatgtcgcccaaagataagggtttttcatgtccggacttcacggggcattttaggaagaaatgcaatttcgccacaacccctgtttgtgaatatgatggcaacatggtgtctggatacaagaaagtaatggcaactatagacagtttccaggcctttaatacatccaacattcactacaccgatgagcggatcgaatggaaggacactgatggcatgctgaaagaccatcttaatatcttggtcaccaaggatattgacttcgagaacctcggggagaatccatgcaaggtgggactgcagacagctagcatcgacggcgcctggggttctggggtgggatttacgctaacctgtcagattagcctgactgaatgctcccgcttcctcacatcaataaaagcatgcgatatggctatctgttatggcgcccaaagtgtcaccctggttagaggtcagaacacagtgagggtaagcggcaaagggggacactctggctcctcatttaagtgctgtcatgggactgactgcagtcaccagggacttcaagcgagcgctccccacttggataaggtgaatggcattgtcgagcaggaatccacccaggtgtacgacgatggtgcccctcagtgtgggatctcttgctggttcgttaaatcgggagagtggattaagggcatctttagcggtaactggatagtgatcgtcgtgctgattttcttatttctcctgtcacttatcctgttgtccttcctctgtcccattcgtaagcataaacggagttga

SEQ ID NO: 10028 - RNA, 3408 nt, synthetic construct
  misc_feature 1..3408: note = derived and/or modified CDS sequence (opt3) from DOBV(GRW/Aa)__JQ026205.1__GP
  source 1..3408: mol_type = other RNA
atgatcatgtggggcctgctccttaccctgagcttgattaacttaggggcctccctgagaaatgtgtacgacatgaagatagagtgcccccactctatcaacttcggagaatcaagtgtcacaggtaaaggcgagctacctccactcctgcttactgatgctgaaacgctggttccggagagctcctgtaatatggacaaccatcagtctttgtcgattacccaaaaggtgacaaaagtatcatggaggaagaaagcagataaggtgcaggccgcgaaggacagctttgaaactaccagttccgaggtcaatctcaaagggacatgcaccctgactcaccggatggtggaggaatcttatcgcagccgaaagtccgttatctgttacgatctgtcatgcaacagtacacattgtaaacccaccatgcacatgattgtgcctgtccatagctgcaatatgatgaagtcttgtctcgtgggattaggcccatatcgtatccaggtagtttacgagagaacgtattgcactaccggtatactgacagaagggaaatgtttcgtgcccgaccagtccatcatttcagtcatcaagaacggagtgtttgatattgctagcgtgagtatcgtctgcttctttataaggattaagggcacttcttacaaaatcatgacctccattaaggagagcaatcctaacaattgtaacgacacagataataaagttcaaggctattacctttgcatcgtgggggccaactcgtctccagtatacgcaccctccaccacggacttccggtcagtggaggccttggctagtctgctacgcagcccttatggagaagatcacgacctcgcaggagaggaagtcgccacttactccatcgctggccaggtggaggggaaggttccacacacagccaatgcggcaaacatgctgtttaccgccttctctggtattccgagctattcaagtttttccgtgttcactggcaaccaggatggtaatgtcatatacagccccgggctttttcctaaactgaaccagtcttcatgcgaaaaggtggctttgccactcatctgggagggatatattgacctgcccggctactatgagacagtacatccttgtaatgttttctgcgtgagtagcggcccaggggcctcctgtgaagcattttctgagggaggtatcttcaacataacctcgcccacgtgcttagtcagcaaacaaaatagattcagggctgccgaacagcagattaactttgtgtgtcagcgggtcgaccaagatatcgtgatctactgcaatggccagaagaagaccattctgacaaaaactctcgttatcgggcagtgtatttactccgtgacctcacttttcagtataatgccgggagtagcgcactctatcgccattgagctgtgcgtccctggctttcatggttgggcaacagctgccttgctaactaccttctgttttgggtggatcctgatccccagcattacactcgctatactgatcgtgcttaagttctttgccgcactgttgcacaactcctcacaagaaaatcgcttcaaaattatcctcaagaaaattaaggaggagtttgaaaagaccaaaggcagcatggtttgcgaggtgtgtaagtatgaatgcgagactggaaaagaactgaaggcccacaacttatcttgcccacagtcccagtgtccttactgcttcacgcattgtgagctgacagagagtgcttttcaggcgcactatcgagtctgccaagcaacccatagattcagggacgatctcaaaaagactatcactccccagagcacatctccaggctgttaccggaccctaaatctgtttcgttataagtcccgctgctacatattcactgtgtgggtaatccttttgattatcgaatcaattctgtgggccgctagtgccagcgagatcgtgctcgaaccctcgtggaacgacaatgcacacggggttggagtcgtgcctatgcatacagatctggagcttgacttctccctgccatctagctcaaaatatacgtacaagagaaaattgaccagtccgataaaccaggagcagtccgtggatctccacattgaaatcgagtctcaaggtattagcacttccgtccacgccctgggccattggtttgacgggaggttaaatctgaagacatcattccactgttacggagcttgcaccaaatatgaatacccctggcatacagccaagtgtcactttgagcgggatttcgaatatgagaacagctggagttgcaaccctgcagactgtccaggcatcggtactgggtgcaccgcgtgcggcctatacctcgatcagctgaagcccgttggatctgcttataaacttataacggtgcgatactcccgcaaggtgtgtgtacagtttggcgaggaaaatttgtgcaaaaccatcgacatgaacgactgtttcgtcacaagacacgtgaaggtttgcattatcgggactgtgagcaaattttcgcagggagataccctggtcttcctcggtcctatggagggcgggggactgatttttaaggactggtgtacaactacctgccaattcggcgatccaggtgacatcatgtcacccaaagataaggggttttcttgtccggacttcacgggccattttaggaagaaatgcaatttcgccacaacccctgtgtgtgaatatgatggaaacatggttagtggctacaagaaagtgatggcaactatagactccttccaggcctttaatacaagcaacattcactacaccgatgagcggatcgaatggaaggacccagatgggatgttaaaagaccatctgaatatccttgtaactaaggatattgacttcgagaacttgggagagaatccctgcaaggtcggcctccagaccgcttctatcgacggtgcctgggggagcggagtgggctttacactgacgtgtcagatttccctaaccgaatgctcacgcttcctgaccagtataaaagcatgcgatatggctatctgttatggtgcccaaagcgtgacactcgtcagaggccagaacaccgttagggtgtctgggaagggaggccactccgggtcaagttttaaatgctgtcatggaacagactgcagccaccagggcctgcaagcgtccgcccctcaccttgataaggtaaatggtattgtggagcaggaatctactcaggtctacgacgatggggctccccagtgtggaatctcgtgctggttcattaaaagcggcgagtggatcaagggtatattttcaggcaactggatcgtgattgttgtgttgatcttcctgtttttactctccctgattcttctgagtttcttgtgtccaatccgtaagcataaacggtcttga

SEQ ID NO: 10029 - RNA, 3408 nt, synthetic construct
  misc_feature 1..3408: note = derived and/or modified CDS sequence (opt3) from DOBV(Slo/Af-BER)__GU904035.1__GP
  source 1..3408: mol_type = other RNA
atgatcatgtggggcctgctccttaccatgattctgatagacttcggggccagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcaccctgtcccaccggatggtggaggaatcttatcgcaatcgacgtagcgttatctgttacgacttgtcctgcaactcaacacattgtaagcccaccatgcacatgatagtgcctgtccatagttgcaatatgatgaaaagctgtctcgtggggctgggaccatatagaatccaggtagtttacgagaggacttattgcacaaccggcattctgacggaaggtaagtgttttgtgcccgatcagtctatcgtctccgtgattaaaaacggggtgttcgacatcgcatcagtcagcatagtttgctttttcattcgggtgaagggaactaattacaagatcatggccagtattaaaaccgctacagcaaacaattgtaacgatactgacaataaggtacaaggctattacctctgcatcgtgggcgggaactcttcccctgtctacgccccaagcaccacagattttcgctcgatggaggctttagcctctctgcttagagcgccccacggagaggaccacgatttgtccggtgaagaggtggcaacctattcaatcgccggccagattgaagggaaaatacctcatacggctaatgccgcaaacatgctgttcactgcttttagtggaatcccaagctactcctctctaagcgttttcattggctcacaggacggtccgatcatatatagtcccgggctctttcctaagctgaaccagtccagctgcgacaaagtggcccttccactgatttgggagggatacatcgatttgcccggctattacgaaacagtccacccttgtaatgtgttctgcgtactctctggcccaggggcgtcatgtgaggcctttagtgagggaggtatcttcaacattaccagccccacttgcctggtttccaagcaaaataggttccgggcagctgaacaacaggtgaactttgtctgtcagcgcgtggaccaggatatcattatatattgcaatggccagaaaaagacaatcttaaccaagacgctggtcattgggcagtgtatctactctgtgaccagcctcttctcgatcatgccgggagttgcccattccattgctatagagctttgcgtgcctggctttcacggttgggccacagcagccctgttgactaccttctgttttgggtggatcctaattccctcaatcacactggctgtactcgtcgtgctgaaattctttgcggcaattcttcacaacagttctcaagaaaatcgattcaagatcatactgagaaaaatcaaggaggaatttgagaaaactaagggcagcatggtttgcgaggtgtgtaagtacgaatgcgagaccggaaaagaattgaaggcccataacctctcctgcccacagtcacagtgtccttattgcttcacacactgtgagcccaccgaaagcgcttttcaggcccattacaaagtctgccaagcaactcacaggttccgggacgatctgaagaaaacgattacaccacagtctacctcccccggctgttatcgtactttaaatctgtttcgctacaagagtagatgctatatcttcaccgtgtgggtaacactactcattatcgagagcataatgtgggccgcttctgcctccgagaacgtgctggaaccttcatggaatgacaacgcacatggggttggagtcgtgccaatgcacaccgatcttgagttggacttcagtctgccgagctcgtccaagtacacttataaaaggaagctcacatctcccctgaatcaggaacagagcgtggatcttcacattgagatcgagtcacaaggtattagtacgtccgtccatgcgctgggccactggtttgacgggcggttgaacctcaaaacctctttccattgttacggagcttgcactaagtacgaatatccttggcacacagccaaatgtcactttgagcgagatttcgaatacgagaatagctggggctgcaacccagcagactgtcccggtatcgggaccggctgcacagcctgcggactgtatatagaccagttaaagcctgttggctccgcttacaagctgatcactgtgcgctattcaagaaaagtgtgtgtacagtttggggaagagaacctatgcaagaccattgatatgaatgactgtttcgtcacgaggcatgtgaaagtttgcatcattggaaccgtgagcaagtttagtcagggtgatacactcgtcttcctgggcccaatggaagggggaggccttatctttaaagactggtgtacttctacctgccaattcggtgatcccggggacataatgtccccgaaggataaaggctttagctgtcctgacttcacaggacactttcggaagaagtgcaacttcgccactaccccagtgtgtgagtacgatggcaatatggtttcggggtataaaaaggtgatggcaacgattgactcattccagtcttttaacacaagttccatccattacaccgatgagcgcatcgaatggaaagaccccgatggaatgttgaaggaccacctgaatattctcgtaactaaagacatcgatttcgagaacctgggcgaaaatccttgcaaggtcggtttacagacaagctctattgagggggcttggggaagcggcgtgggttttaccctgacttgtcagatatcccttaccgagtgctcaagattcttgacaagtatcaaggcctgcgacatggcgatttgttacggcgcccaaagcgtgacgctcatcagggggcagaacaccgtcaaagtttctggaaagggcgggcattccggatcaagttttaaatgctgtcacggcactgattgcagccagcaaggtctgcaggcttccgcaccccacctagacaaggtgaatgggattgtagaacaggattctgagaaagtgtatgacgatggagccccacagtgtggcatctcgtgctggttcgtcaagagcggtgaatggataacaggcatctttaacgggaattggattgtgatcgttgtgctggtcttctttttcattctctcactgatccttttgtccctgttatgtcctatacgtaagcataaacggagttga

SEQ ID NO: 10030 - RNA, 3408 nt, synthetic construct
  misc_feature 1..3408: note = derived and/or modified CDS sequence (opt3) from HTNV(76-118/POR)__KT885048.1__GP
  source 1..3408: mol_type = other RNA
atgggcatctggaagtggctggtgatggccagcctcgtctggcccgttcttaccctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcagtatcctgtgcccggtgcgaaaacacaaaaagagctga

SEQ ID NO: 10031 - RNA, 3408 nt, synthetic construct
  misc_feature 1..3408: note = derived and/or modified CDS sequence (opt3) from HTNV(76-118)__Y00386.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaagtgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactcagcttaattgcatactccggaataccttcttatagctcactgagtatccttacctccagcacggaggccaagcacgtgttttctccaggcttgttccccaaactgaaccatactaattgcgacaagtcagctattcctctaatctggacaggtatgatagacctcccagggtactacgaagccgtccacccctgtaccgtgttttgcgttctgagtggaccgggcgcaagctgtgaggctttctccgagggcgggattttcaacatcacttctcctatgtgccttgtgtcgaaacagaatcggtttcgcctgacagaacagcaggtaaacttcgtctgtcaaagagtggatatggacatcgttgtgtattgcaacggacagaggaaggtcattttgaccaagacgctcgtgatcggtcagtgtatttacaccataacaagcctgttttccttactgcccggcgtagcccactcaatcgcggtggagctctgcgttccagggttccatggatgggccactgcagcccttctggtcaccttttgtttcggctgggtgttgattcctgctatcacatttatcattctaactgtgctgaaattcatagctaatatctttcacaccagtaaccaagaaaatcggctcaagtctgtcctgcgcaaaattaaggaggaatttgagaaaacaaagggtagcatggtttgcgatgtgtgtaagtatgagtgcgaaacctacaaagagcttaaggcccatggggtgtcctgcccccagtcacagtgtccatattgcttcactcactgtgaacccacggaggcagccttccaggctcattacaaagtatgccaagtcacacaccgatttagagacgatctgaagaaaaccgtgactcctcagaacttcaccccaggctgttataggacattgaatctcttccggtacaagagccgttgctacatctttaccatgtggattttcctgttagttctggaatctatcctatgggcggcatccgccagtgagactccgctcacacccgtgtggaacgacaatgctcacggagtcggcagcgtgcctatgcatacggatctggagcttgacttttctttgacctcctcaagtaagtatacttaccgcagaaaactgacaaacccactcgaagaggcccagagcatagatctgcacatcgaaattgaggagcagaccatcggggttgacgtgcatgcacttggacactggttcgatggtaggctgaatttgaagacatcgtttcactgttatggcgcctgcactaaatacgaatatccctggcataccgctaagtgtcactacgagcgggactatcaatacgaaacgtcctgggggtgcaacccttctgactgtccaggagtaggcaccggttgcacagcctgcgggctctacctggatcagttaaaacccgtcggcagcgcatataagattatcactatacgatactcacgcagagtgtgtgtgcagttcggagaggaaaatctgtgcaagattatcgacatgaacgattgttttgtcagtaggcatgttaaagtgtgcattatcggcaccgtatccaagttctctcagggggacacactactctttttcggaccgctggagggtggcgggcttatatttaaacactggtgtactagcacgtgccaattcggagatcctggcgacatcatgtccccacgggataaggggtttttgtgtcccgagttccctgggtcattccgcaaaaagtgcaattttgcgaccacacccatttgtgaatatgacggcaacatggtgagcggatacaaaaaggtcatggctaccatcgatagtttccagtcttttaatacttccacaatgcatttcaccgacgagagaattgaatggaaggatccagacggcatgctgagggatcacatcaacatactcgtgactaaagacattgactttgataacctgggggagaatccttgcaagatcggattacagaccagctcgatcgaaggcgcctggggttcaggggttggattcacactgacgtgtcttgtgtctttgaccgagtgccccacttttctcacaagtattaaagcatgcgacaaggccatctgttatggcgctgagtccgtcaccctgacacgtggtcagaacactgtgaaagttagcggcaagggtggacactctggcagcaccttccggtgctgtcatggggaagattgctcccaaattggactacacgccgcagctccacatctggacaaggtgaatggcatatcagagatcgaaaacagtaaagtctacgatgacggtgccccgcagtgtgggattaagtgctggtttgtaaaaagcggagagtggatctctggcattttctccggtaattggatcgtgctcatagttctgtgtgtgtttcttttgttctcactggtcttactcagtatcctgtgccctgtgcgaaagcacaaaaagagctga

SEQ ID NO: 10032 - RNA, 3408 nt, synthetic construct
  misc_feature 1..3408: note = derived and/or modified CDS sequence (opt3) from HTNV(A16)__AF288645.1__GP
  source 1..3408: mol_type = other RNA
atgggcctgtggaagtggctcatcatggccgtgcttgtctggccctgcttcgctctgagaaacgtttacgacatgaaaattgagtgtcctcacaccgtgaattttggggaaaacagcgtagtgggatatgtcgagttgccaccgatgcccatagcagatatcacacagatgatgcctgaatcctcttgctcaatggacaatcatcaaagtttaaacactattacgaagtacacccaggtgagctggaggaaaaaggccgatcaggcgcagtcctctcaaacatcgttcgagactgtttcaagcgaagtggactttaaaggtacctgtgtcctgaagcacaagatgatcgaggatagttatcggtcccgccgatctattatctgctacgacctaagctgtaattccacattctgcaaaccaaccctctatctgatagtgcccgtacatgcttgtaacatgatgaagtcatgccttatcgccctgggcccttaccgtgttcaggtggtctatgagagaacttactgtatgagtggggtgttgctcgaaggaaaatgctttgtgccagatcagagcgtcgtttctattatcaagcacggcattttcgacatcgcatccgtgcatatagtatgctttttcgtggccattaaaggttcaacatacaagatcctggagcaggtcaagaaaagttttgaactgacctgtaatgatacggacaacaagattcaagggtattacatctgcctcgtgggaggcaatagtgctcccatctatgttcctactttagatgacttcaggtctatggaggcatttgccggcattttcaaatccccacacggggaggatcacgacctggctggagaagaggtggccagctactcgatagtcggtccggcgaacgcaaaggtgccccattctgcctccgctgacacccttggcttggtagccttttcagggatccctagttatagctccttctctgttctgacaggaagcactgatgcacggcacgtgttctcaccaggctttttcccccagctaaatcagacccgctgtgacaaaacagctattcctctcacctggacgggtatgatcgatctgccagggtactatgaagccgtccatccctgcactgtgttttgtgtccttagtggaccgggcgcgtcctgcgaggccttcagcgaaggcgggatatttaacattacatctcctatgtgtctggtgtcaaagcagaatagattcaggagtagcaaacaacaggttaactttgtgtgccagcgggtagacatggatatcgtcgtgtactgtaatggacaaaagaaggttatcttgaccaaaactctcgtgattggtcagtgcatctacacaattacctccctgttctctttactgcccggcgtcgcacactcgatagctgtggagctctgtgtaccagggtttcacggatgggccacggctgcccttctggtgaccttctgctttggctgggttttgatccctgcagtcaccctagtgattctgactatcctcaagttcatcgccaacatttttcataccagcaaccaggagaatcgcctgaaatccgtgcttaagaaaataaaggaagagttcgaaaagacaaaaggttcaatggtctgtgacgtttgcaagtatgagtgcgaaacttacaaagagctgaaggctcacggggtgagttgtccccagtctcaatgcccatattgtttcacccattgcgagcccacagaagcggcatttcaggcccactacaaagtgtgtcaggtaacccatcgattcagagatgacttgaagaagactgtcacgcctcagaactttacaccaggctgctataggaccctcaatctgttccggtacaaaagccgttgttatatctttactatgtgggtgttcttactgattctagagtccatcctctgggctgcctcagcaagcgaaaccccgctgacacccatttggaacgataatgcccacggagttggctctatccctatgcacaccgaccttgagttggatttttccctgactagcagctctaagtacacataccgcagaaaactcacgaacccactggaagagacccaagctgtggaccttcatatagagctggccgaacagactatcggggtcgacgtgcacgcattgggacattggttcgatggtaggctcaatctgaagacatcctttcactgctatggcgcgtgtaccaaatacgagtatccctggcacacagctaagtgccattacgaacgggactatcagtacgagacttcatgggggtgtaaccctagtgattgcccaggagttggcaccggttgcacggcctgtgggttatatctggaccagctaaagcccgtgggcagcgcatacaaaattatcaccattcgatactcgcgcagagtatgcgtccaattcggagaggaaaatctctgtaaggtgatcgatatgaacgactgctttgtgtccaggcacgtcaaagtttgtataattggcacagtgtctaagttcagccagggggatactctgctctttttcggaccgttggagggtggcgggctgatcttcaaacattggtgcacctcaacatgtcagtttggagaccctggcgatattatgagtccacgggacaagggtttcctctgccccgaatttcctgggtccttccgcaaaaagtgtaattttgccactacacccctgtgcgagtatgatggcaacatgatctctggatacaagaaagtaatggctacgatagacagcttccagtcctttaatacatcaaccatgcacttcactgatgaaagaatcgagtggaaggacccagacggcatgttaagggatcatattaacatcctggtgacaaaagacattgattttgacaatcttggggagaacccttgtaagatcggattgcaaaccagcagtatagaaggcgcctggggttctggggtcggattcactcttacctgcctggtgtccctaacagagtgccccacgtttctgaccagcattaaagcatgtgataaggctatctgctatggcgccgaatcggttactctcacacgtggtcagaacaccgtgaaggtctcaggcaaagggggacactctggcagtacattcaagtgttgccacggggaggactgttcccagactggactgcatgcggccgctccacaccttgataaagtgaatggcatcagcgaaattgagaactctaaggtttacgacgatggtgcaccgcaatgcgggatcaaatgttggttcgtcaagagcggagagtggatttccggcatattttcaggtaattggatcgtgttgattgtactgtgcgtgttcttactctttagtctggttcttctgagcgtgttgtgtcctgtccggaagcataaaaagtcttga

SEQ ID NO: 10033 - RNA, 3408 nt, synthetic construct
  misc_feature 1..3408: note = derived and/or modified CDS sequence (opt3) from HTNV(A9)__AF035831.1__GP
  source 1..3408: mol_type = other RNA
atgggcatctggaagtggctggtgatggccagcctcgtctggcccgcttacacccttagaaacgcatatgacatgaaaattgagtgccctcacacagtttccttcggggaaaattctgtgataggatacgtagagctgccaccgatccccttggccgatactacgcagatggtgcctgaatcaagttgtagcatggacaaccatcaatccttaaataccattacaaagtatactcaggtctcttggaggggtaaagcggatcacgctcaggcctcgcagaactcatttgaggcagtgagcgccgaagttgacctgaaggggacctgcgtgctaaaacataagatgctcgaggagagttaccggtcccgcaagtctatcgcttgttatgatctgagctgcaattccacatactgtaaaccaaccctttatatgattgtccccatccacgcatgcaacatgatgaagtcatgtctgatagccttggggcctcatcgagtgcaagtagtttacgaacgtacttactgcatgacaggagtgctcatcgagggcaaatgtttcgtcccagaccagagtgtggtgagcattatcaagcacggtatttttgatatcgcttctgtccacatagtttgcttctttgtggccgtaaaagggaatacctataagattttcgaacagatcaagaaatcctttgagtcaacgtgtaacgacactaagaataaagtgcagggatactatatttgcatcgtcggcggcaacagcgcgcccatctacgtgcctaccctggatgacttcagaagtatggaggcattttctgggattttcaggtccccacatggagaagatcacgacctggccggtgaggaaatagctagctattcgatcgttggcccggccaatgcaaaggtgccccattctgcttcctcagatacactcagtttaactgcctacagcgggattccttcctattctagcctgtcaatccttgcgggaagtgccgaggcaaaacacgtcttttccccaggcttctttccccaattgaaccacaccaagtgcgacaaaacagctatacctctgatgtggaccggtatgattgacctaccagggtactacgaagccatccatccctgtacggtgttctgcgtactcagcggaccgggcgcttcttgtgaggccttctcagagggcgggatctttaatattacaagtcctatgtgcctggttagcaagcagaaccggttccgccttactgaacaacaggtgaattttgtctgtcagagagtggatatggacatcattgtctattgcaacggacagaggaaggtgatactgaccaaaactttggttatcggtcagtgtatttacacaatcacctccctcttctctctgttacccggcgtggcacactcgatcgccgtagagctgtgcgtcccagggtttcatggatgggctacggcggcactccttgtgaccttctgttttggctgggttctgattcctgccatgacattcatagtgttgactatcctaaagtttattgctaacatcttccacaccagcaatcaagaaaacaaactgaagtccgtcctccggaaaattaaggaggaatttgagaagacaaaaggttcaatggtgtgcgatgtatgtaagtatgagtgcgaaacttacaaagagctgaaggcccatggggtgagttgcccccagtctcagtgtccatattgcttcacccactgtgaacccacagaggcagcctttcaggctcactaccgcgtttgccaagtcacccatcgattcagagacgatcttaaaaagactgtgacgcctcagaatttcacaccaggctgttataggaccctgaacttgtttcggtacaagagccgttgctacatcttcactatgtgggtgtttctcctggtcttagaatccatactgtgggccgcatcagcgagcgagatcccgctaaatcccgtttggaacgacaatgctcacggagtgggctctgtgcctatgccaaccgatctcgagctggacttctcccttacaagtagctctaaatatacctaccgcagaaagttgactaaccccctggaagagtcccaggccattaatctccatatcgaaattgaggagcagacaatcggggtagatgtccacgcactgggacactggtttgacggtaggcttaacctgaaaacgtcattccattgttatggcgcctgcaccaagtacgaatatccttggcacactgctaaatgtcattacgagcgggattatcaatacgaaacaagttgggggtgcaatccaagcgactgtcccggagtgggcaccggttgcacagcctgcgggttgtacctcgaccagctgcgagcagttggctcggcttataagataattactatccgctactccagaagggtgtgtgtccagtttggagaggaaaacttatgcaagattatcgatatgaatgactgtttcgtgtctcggcacgttaaagtgtgcataatcggcaccgtaagcaagttttcacagggggatacgctgctattctttggaccgctcgagggtggcgggctgattttcaaacattggtgtaccagtacatgccaatttggagaccctggcgatatcatgtccccacgcgacaagggtttcctttgtcccgagttccctgggtctagcaggaaaaagtgcaactttgccactacccccttgtgtgaatatgatggcaatatggtctccggatacaaaaaggtgatggcgacaattgactcattccagagctttaacaccagtactatgcacttcacggatgagagaatcgaatggaaggacccagatggcatgctgcgtgaccacataaacattctcgtgacaaaagatatcgactttgagaatctgggcggaaacccttgcaagatcggcttacagacctcttccattgaaggtgcctgggggagcggagtcggcttcactctgacatgtcttgtttcgttgaccgagtgccccacttttctcacctcaatcaaggcttgcgacaaagcaatttgttatggtgccgagtctgtgacactgacgcggggccagaataccgtaaaagtgagtgggaagggaggccattccgggagcactttcaagtgctgtcacggagaagagtgctctcaaataggcctacatgctgccgcaccacacctggataaagtcaacggtatcagcgaaattgagaataacaaggtgtacgacgatggggcgccgcagtgtggaatcaaatgctggtttgttaagtccggcgaatggatttcaggtatcttcagtggcaattggatagtgctcatcgtcctgtgtgtgtttcttttgttcagcctgattttactctctatcctgtgccctgttcgaaaacataagaagtcctga

SEQ ID NO: 10034 - RNA, 3408 nt, synthetic construct
  misc_feature 1..3408: note = derived and/or modified CDS sequence (opt3) from HTNV(84FLi)__AF345636.2__GP
  source 1..3408: mol_type = other RNA
atgggcgtgtggaagtggctggtcatggccagcctcgtttggcccgcttgcacccttagaaacgtgtacgacatgaaaatcgagtgtcctcacacagtatccttcggggaaaattctgtgattggatatgtcgagctgccaccgatgcccttggcagatactacgcagttagtgcctgaatcaagttgcagcatggacaaccatcaatccctgaataccataacaaagtacactcaggtttcttggaggaaaaaggccgatcaggcgcagtcgtcacaaaacagctttgagaccgtgagtgtcgaagtggacctaaaaggtacatgtgtactcaagcacaagatgatcgaggagtcctatcggtctcgcaaaagcattacctgctacgatctgtcctgtaattcaacttattgcaagccaacactttacatgatcgttcccattcatgcttgtaacatgatgaaaagttgcctgatcgccttgggcccttatcgagtgcaggtcgtgtacgaacgtacctactgtatgacgggggtgctcatagagggaaagtgcttcgtcccagaccagagcgttgtgtctatcattaaacacggcatctttgatattgcatccgtaaagatcgtgtgtttctttgtcgccgtgaagggtaatacttataaactgttcgaacaggttaagaaatcatttgacagtacctgcaacgatacagagaataaggtgcaagggtactatatatgcattgtcggaggcaacagcgctcccatctacgtgcctactctggacgatttcagatctatggaggcattttccggcattttcaggagcccacatggggaagaccacgatctcgccggagaggaagtagcttcgtattctatcgttggtccggccaatgcgaaagtgccccactccgcatcaagtgacaccttaagcctgatcgcctactccggcattccttcttatagctcacttagtatattgacatccagcaccgaggctaagcatgtcttttctccagggttctttccccagctgaaccacacgaaatgtgacaagactgccatccctctaacatggaccggaatgattgatctcccaggctactacgaagcaatccatctgtgcactgtgttctgtgtcctttcaggtcccggggctagttgcgaggccttcagcgagggaggcatatttaatattacatccccgatgtgtctggtgtctaagcagaaccagttccggttgaccaaacaacaggttaattttgtgtgccagcgcgtagacatggatatcgtcgtgtattgtaacggccaaagaaaggttatcctcacgaaaaccatggtgattgggcagtgcatctacacaattacttcgctgttcagcttactgcctggagtcgcgcactccatagccgtggaactctgtgtacccggttttcacggctgggcaaccgctgcccttctggtgacattctgctttgggtgggttttgatcccagctgtcactttcattatcctaaccgtgctgaagtttgtggccaacatcttccatacatcaaatcaggagaacaggctcaaaagtgtcctgcggaagattaaggaagagtttgagaaaaccaagggatctatggtttgtgacgtgtgcaaatatgagtgcgagacttaccgcgaacttaaggcacacggcgtgagctgtcctcagtcccaatgcccctattgtttcacgcattgcgagccaacagaagccgcttttcaggcgcactaccgagtatgtcaggtcacccatagattcagggatgacctgaaaaagactgtgactccccagaatttcacacctggttgctatcggaccttgaacctctttcgttacaagtcacgctgttacatattcactatgtgggtttttctgttagtgctggagagcatcctatgggcagcctctgcttccgaagtcccactcaatccgatttggaacgataatgcccacggggtgggcagtgttcccatgcacacagacctggagcttgatttcagcttgacgtcttcctcaaaatatacctacagaaggaagctgactaaccctctcgaggaaacacaagcaatcgacctgcatattgagatcgaagaacagaccataggagtggatgtacacgcccttggccattggtttgacgggcggctgaatttgaaaacaagtttccactgctatggagcttgtactaagtacgagtatccatggcacaccgccaaatgccattacgaacgagactatcagtacgagacgagctggggttgtaacccctcggattgccctggcgtcgggaccggatgcacagcatgtggcctctacctggaccagttaaagccagtgggttccgcgtataagatcattactatccgctactctagaagggtgtgcgtccaatttggggaagagaatctgtgtaaagttattgatatgaacgactgcttcgtgagccggcacgtaaaggtgtgtatcataggcaccgtctcaaaatttagtcagggagatacactactcttctttggccccctggaagggggaggtcttattttcaagcattggtgcacttccacctgtcagtttggcgacccgggggatatcatgtctcctcgcgacaaaggattcttgtgcccagagttccccggcagctttagaaagaaatgtaatttcgctacgacacctctgtgcgagtatgatggtaacatgatttccgggtacaagaaggtgatggccaccatcgactcatttcagagcttcaataccagtacaatgcactttaccgatgaaaggatagagtggaaagaccccgatggcatgctccgtgaccatatcaacattctggttactaaggacatcgatttcgacaacttaggagaaaatccatgtaaaattggcctgcaaacctcttccatcgagggggcatggggaagcggcgtgggttttacacttacgtgcttggtctcgctcaccgaatgccctactttcctgacatcaataaaggcctgtgataaagctatttgctatggggccgagtctgtgaccctaacacggggacagaacactgttaaggtgagtggcaagggtggccactccgggagcacctttaaatgttgccacggagaggactgttctcagacgggcctgcatgcagctgcgccccacctcgataaggtcaatgggatcagcgaaatcgagaactccaaagtatacgacgatggagccccacaatgcggcattaagtgttggttcgtgacatcaggtgaatggatcagtgggatttttagcggaaattggatagttctgatcgtgctttgcgtcttcttgctgttctctttagtgctcctgtccgtactttgtccggtgcgaaaacataagaagtcatga

SEQ ID NO: 10035 - RNA, 3408 nt, synthetic construct
  misc_feature 1..3408: note = derived and/or modified CDS sequence (opt3) from HTNV(Aa03-161)__KT934990.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccatcaccttcatcattctgacaatactcaaatttatcgctaatattttccacacctccaaccaagagaatcggctgaagtcagtccttcgcaaaatcaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacattttcacaatgtggatctttttactggtactagagtcaatactctgggcggcaagcgcctctgagacgccgctgacccccgtctggaacgacaatgctcacggagtgggctccgttcctatgcatactgatcttgaattggacttcagtctgacatctagctccaagtacacctatcgcagaaaactcacaaacccactggaggaagcccagtcaatcgatcttcacattgagatcgaggaacagactattggggtggacgtccatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtgggcactggttgcaccgcctgcgggctgtacttagatcgactgaaacccgttggctccgcatacaagatcataacaattcgctattctagaagggtgtgtgtacagtttggagaagagaatctatgcaagatcattgacatgaacgattgtttcgtcagccggcatgtgaaagtgtgcatcataggcactgtctcaaagtttagtcagggggacaccctcctgttctttggaccgcttgagggtggcgggttgatcttcaaacactggtgtacgtccacatgccagtttggagatcctggcgacattatgtctccacgcgataagggtttcctgtgtcccgagttccctgggagctttagaaagaagtgcaatttcgcgaccactcccatctgtgaatacgacggcaacatggtttccggatataggaaagtgatggctacaattgattcatttcagagcttcaataccagtactatgcattttaccgacgaacgtatcgagtggaaggatccagacggcatgctccgggatcacataaacattctggtaacaaaggacatcgacttcgataacttaggggaaaatccttgcaaaatcggactgcagacgtcttccattgagggcgcctggggtagcggggtgggatttacccttacttgtttggtctcgctcacagagtgccccaccttcctgacatcaatcaaggcatgcgacaaagccatttgttacggcgctgaatctgtgactctaacccgaggtcagaacacggttaaggtgagtggcaaagggggacactccggcagcacatttaagtgctgtcatggggaggattgctctcagataggactgcacgccgcagctccacatctcgacaaggtcaatggcatcagcgaaatggagaactccaaagtgtatgatgacggtgccccgcaatgtgggattaagtgctggttcgttaaatcaggagaatggatcagtggcatttttagcggtaattggatcgtgctgatagtcctttgtgtattcttgctgttctctttagtgctcctgtccatcctttgccctgttagaaagcacaaaaagtcatga

SEQ ID NO: 10036 - RNA, 3408 nt, synthetic construct
  misc_feature 1..3408: note = derived and/or modified CDS sequence (opt3) from HTNV(Aa03-386)__KT934991.1__GP
  source 1..3408: mol_type = other RNA
atgggcatctggaagtggctggtgatggccagcctcgtctggcccgttcttaccctgagaaacgtgtacgacatgaaaattgagtgccctcacacaatatccttcggggaaaattctgtaatcggatatgtggagttgccaccgatgcccttagctgatactgcacagctggtccctgaatcaagttgtagcatggacaaccatcaatccctaaatacgattaccaagtacacacaggtgtcttggaggggtaaagccgatcagtcgcagtcaagccaaaacagttttgagactgtttccaccgaagtggacctcaagggcacatgcgtcctgaaacacaagatggtggaggagtcttatcggagccgcaagtccatcacctgttacgatctttcatgcaatagtacttattgtaaaccaacactgtacatgattgtacccatccatgcgtgcaacatgatgaaaagctgtttgatagctctcgggccttatcgagttcaggtggtctacgaacgtacctactgcatgacgggagtgctgatcgagggcaaatgtttcgtgccagaccagtctgtcgtttccattatcaagcacggtatttttgatatcgcctcagtgcatatagtatgcttctttgtggcagtcaaagggaatacttataagattttcgaacaggtgaagaaaagttttgagagtacctgtaacgacacagagaataaggttcaaggatactatatctgcattgtgggcggcaactctgcccccatctacgtccctactctggatgacttcagatccatggaagcatttaccgggatcttcaggagcccacacggagaggatcacgacctcgctggtgaagagacagccacctattcgattgtgggcccggctaatgccaaagtaccccattctgcgtcctcagatacgttaagtctgatagcatttagcgggatcccttcctactctagcctttcaattttgactagctccacagaagccaagcacgttttcagcccaggactgtttcccaaactaaaccataccaattgcgacaagggcgctatccctctcatgtggactggtatgatagacctgccagggtattacgaggccattcacccctgtacagtgttctgcgtcctttctggaccgggcgcatcatgtgaggctttcagtgaaggcgggatctttaacatcaccagccctatgtgcctggtgtccaaacagaatcggttccgcttgacggagcagcaggtcaactttgtgtgtcaaagagttgatgtggacattgtagtctactgcaacggacagaggaaggtgatcctcaccaagacactggttattggtcagtgtatatatactatcacctctttattctcgctgctccccggcgtggcccacagcattgcggtcgaactttgcgtgccagggtttcatggatgggccacagcagctctgttggtaactttctgttttggctgggtgctaatccctgccatcaccttcattatactgacaatcctcaaatttattgctaatatcttccacacctccaaccaagagaatcggctgaagtcagttcttcgcaaaattaaggaagagtttgagaaaactaagggtagtatggtctgcgatgtgtgtaagtacgaatgcgagacgtataaagaactgaaggcccatggggtgtcttgcccccagagccagtgtccatactgcttcacacactgtgagcccaccgaagcagcctttcaggctcattataaagtctgccaagttactcaccgattcagagacgatttgaagaaaaccgtgacacctcagaacttcaccccaggctgttacaggactctcaatctgtttcggtataagtcccgttgctacatcttcacaatgtggatatttttactggtgctagagtcaatcctctgggcggcaagcgcctctgagacgccgctgacccccgtatggaacgacaatgctcacggagtcggctccgtgcctatgcatactgatcttgaattggacttcagtctgacaagcagctccaagtacacctatcgcagaaaactcacaaacccactggaggaagcccagtcaattgatcttcacatcgagattgaggaacagactatcggggttgacgtgcatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtcggcactggttgcaccgcctgcgggctgtacttagatcgactgaaacccgtgggctccgcatacaagataattacaatccgctattctagaagggtttgtgtgcagtttggagaagagaatctatgcaagattatcgacatgaacgattgtttcgtaagccggcatgtcaaagtgtgcataatcggcactgtgtcaaagtttagtcagggggacaccctcctgttctttggaccgcttgagggtggcgggttgattttcaaacactggtgtacgtccacatgccagtttggagatcctggcgacatcatgtctccacgcgataagggtttcctgtgtcccgagttccctgggagctttagaaagaagtgcaatttcgcgaccactcccatttgtgaatacgacggcaacatggtctccggatataaaaaggttatggctacaatcgattcatttcaatctttcaataccagtactatgcattttaccgacgaaaggatagagtggaaggatccagacggcatgctccgtgatcacattaacatcctggtgacaaaagacatcgacttcgataacttaggggaaaatccttgcaagattggactgcagacgtcttccatcgagggcgcctggggtagcggggtaggatttacccttacttgtttggtgtcgctcacagagtgccccaccttcctgacatcaattaaagcatgcgacaaggccatatgttacggcgctgaatctgtcactctaacccggggtcagaacacggtgaaagttagtggcaaagggggacactccggcagcacatttaagtgctgtcatggggaggattgctctcagatcggactgcacgccgcagctccacatctcgacaaggtgaatggcattagcgaaatggagaactccaaggtctatgatgacggtgccccgcaatgtgggatcaaatgctggttcgtgaagtcaggagaatggattagtggcatctttagcggtaattggatagttctgatcgtgctttgtattttcttgctgttctctttagtcctcctgtccatcctttgccctgtacgaaaacacaagaagtcatga

SEQ ID NO: 10037 - RNA, 3408 nt, synthetic construct
  misc_feature 1..3408: note = derived and/or modified CDS sequence (opt3) from HTNV(Aa04-722)__KU207182.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatcatagacctgccagggtattacgaggccattcacccctgtacagtcttctgcgtgctttctggaccgggcgcatcatgtgaggctttcagtgaaggcgggatctttaacatcaccagccctatgtgcctggtctccaaacagaatcggttccgcttgacggagcaacaggtgaactttgtttgtcaaagagtggatgtagacattgtcgtgtactgcaacggacagaggaaggttatcctcaccaagacactggtgattggtcagtgtatatatactatcacctctttattctcgctgctccccggcgtcgcccacagcattgcggtggaactttgcgtaccagggtttcatggatgggccacagcagctctgttggtgactttctgttttggctgggttctaatccctgccatcaccttcattatactgacaatcctcaaatttattgctaatatcttccacacctccaaccaagagaatcggctgaagtcagtccttcgcaaaattaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacatcttcacaatgtggatatttttactggtactagagtcaatcctctgggcggcaagcgcctctgagacgccgctgacccccgtctggaacgacaatgctcacggagtgggctccgttcctatgcatactgatcttgaattggacttcagtctgacatctagctccaagtacacctatcgcagaaaactcacaaacccactggaggaagcccagtcaattgatcttcacatcgagattgaggaacagactatcggggtggacgtccatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtgggcactggttgcaccgcctgcgggctgtacttagatcgactgaaacccgttggctccgcatacaagataattacaatccgctattctagaagggtgtgtgtacagtttggagaagagaatctatgcaagattatcgacatgaacgattgtttcgtcagccggcatgtgaaagtgtgcataatcggcactgtctcaaagtttagtcagggggacaccctcctgttctttggaccgcttgagggtggcgggttgattttcaaacactggtgtacgtccacatgccagtttggagatcctggcgacatcatgtctccacgcgataagggtttcctgtgtcccgagttccctgggagctttagaaagaagtgcaatttcgcgaccactcccatttgtgaatacgacggcaacatggtttccggatataaaaaggtgatggctacaatcgattcatttcagagcttcaataccagtactatgcattttaccgacgaaaggatagagtggaaggatccagacggcatgctccgtgatcacattaacatcctggtaacaaaagacatcgacttcgataacttaggggaaaatccttgcaagattggactgcagacgtcttccatcgagggcgcctggggtagcggggtgggatttacccttacttgtttggtctcgctcacagagtgccccaccttcctgacatcaattaaagcatgcgacaaggccatatgttacggcgctgaatctgtgactctaacccggggtcagaacacggttaaagtgagtggcaaagggggacactccggcagcacatttaagtgctgtcatggggaggattgctctcagatcggactgcacgccgcagctccacatctcgacaaggtcaatggcattagcgaaatggagaactccaaggtgtatgatgacggtgccccgcaatgtgggatcaaatgctggttcgttaagtcaggagaatggattagtggcatctttagcggtaattggatagtgctgatcgtcctttgtgtattcttgctgttctctttagtgctcctgtccattctttgccctgttcgaaaacacaagaagtcatga

SEQ ID NO: 10038 - RNA, 3408 nt, synthetic construct
  misc_feature 1..3408: note = derived and/or modified CDS sequence (opt3) from HTNV(Aa05-190)__KT934993.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttaactgatacggctcagctggtgcctgaatcaagttgtagcatggacaaccatcaatccctaaataccatcacaaagtacactcaggtttcttggaggggtaaagcagatcagtcgcagtcaagccaaaacagttttgagaccgtgtccacagaagtcgacctcaaggggacctgcgtgctgaaacacaagatgattgaggagtcttatcggagccgcaagtccatcacttgttacgatctttcatgcaatagtacatattgtaaaccaaccctgtacatgattgtacccatccatgcctgcaacatgatgaaaagctgtttgatagcgctcgggccttatcgagttcaggtggtctacgaacgtacgtactgcatgactggagtgctgatcgagggcaaatgtttcgtgccagaccagtctgtcgtttccattatcaagcacggtatttttgatatcgcttcagtgcatatagtatgcttctttgtggccgtcaaagggaatacctataagattttcgaacaggtgaagaaaagttttgagagtacatgtaacgacactgagaataaggttcaaggatactatatctgcattgtgggcggcaactctgcacccatctacgtccctaccctggatgacttcagatccatggaagcctttacagggatcttcaggagcccacacggagaggatcacgacctcgctggtgaagagaccgcaacgtattcgattgtgggcccggccaatgctaaagtaccccattctgcctcctcagatactttaagtctgatagcgtttagcgggatcccttcctactctagcctttcaattttgacaagttccaccgaagcaaagcacgttttcagcccaggactgtttcccaaactaaaccatactaattgcgacaagggcgccatccctctcatgtggacaggtatgatagacctgccagggtattacgaggctattcacccctgtaccgtgttctgcgtcctttctggaccgggcgcctcatgtgaggcattcagtgaaggcgggatctttaacatcacgagccctatgtgcctggtgtccaaacagaatcggttccgcttgaccgagcagcaggtcaactttgtgtgtcaaagagttgatgtggacattgtagtctactgcaacggacagaggaaggtgatcctcacaaagactctggttattggtcagtgtatatataccatcacatctttattctcgctgctccccggcgtggctcacagcattgccgtcgaactttgcgtgccagggtttcatggatgggcgactgccgcactgttggtaaccttctgttttggctgggtgctaatccctgctatcacattcattatactgaccatcctcaaatttattgccaatatcttccacacttccaaccaagagaatcggctgaagtcagttcttcgcaaaattaaggaagagtttgagaaaacgaagggtagtatggtctgcgatgtgtgtaagtacgaatgcgagacatataaagaactgaaggctcatggggtgtcttgcccccagagccagtgtccatactgcttcacccactgtgagcccactgaagccgcatttcaggcccattataaagtctgccaagttacccaccgattcagagacgatttgaagaaaacagtgacccctcagaacttcactccaggctgttacaggacactcaatctgtttcggtataagtcccgttgctacatcttcacgatgtggatatttttactggtgctagagtcaatcctctgggctgcgagcgcatctgagaccccgctgactcccgtatggaacgacaatgcccacggagtcggctccgtgcctatgcatacagatcttgaattggacttcagtctgaccagctcctccaagtacacatatcgcagaaaactcactaacccactggaggaagctcagtcaattgatcttcacatcgagattgaggaacagaccatcggggttgacgtgcatgccctgggacactggtttgatggtaggttgaatctcaagacgagtttccactgttacggcgcatgcaccaaatatgagtacccctggcatacagccaagtgtcactatgaacgggactaccaatatgagactagctgggggtgcaacccttcggactgtccaggagtcggcaccggttgcacagcttgcgggctgtacttagatcgactgaaacccgtgggctccgcctacaagataattactatccgctattctagaagggtttgtgtgcagtttggagaagagaatctatgcaagattatcgacatgaacgattgtttcgtaagccggcatgtcaaagtgtgcataatcggcaccgtgtcaaagtttagtcagggggacacgctcctgttctttggaccgcttgagggtggcgggttgattttcaaacactggtgtacatctacctgccagtttggagatcctggcgacatcatgtctccacgcgataagggtttcctgtgtcccgagttccctgggagctttagaaagaagtgcaatttcgcaactacacccatttgtgaatacgacggcaacatggtctccggatataaaaaggttatggcgaccatcgattcatttcagagcttcaatactagcaccatgcattttacagacgaaaggatagagtggaaggatccagacggcatgctccgtgatcacattaacatcctggtgacgaaagacatcgacttcgataacttaggggaaaatccttgcaagattggactgcaaacctcttccatcgagggcgcttggggtagcggggtaggatttactcttacatgtttggtgtcgctcaccgagtgccccacattcctgacttcaattaaagcctgcgacaaggcaatatgttacggcgccgaatctgtcaccctaacgcggggtcagaacacagtgaaagttagtggcaagggcggacactccggcagcacctttaagtgctgtcatggggaggattgctctcagatcggactgcacgctgccgcaccacatctcgacaaagtgaatggcattagcgaaatggagaactccaaggtctatgatgacggtgctccgcaatgtgggatcaaatgctggttcgtgaagtcaggagaatggattagtggcatctttagcggtaattggatagttctgatcgtgctttgtgtcttcttgctgttctctttagtactcctgtccattctttgccctgtgcgaaaacacaagaagtcatga

SEQ ID NO: 10039 - RNA, 3408 nt, synthetic construct
  misc_feature 1..3408: note = derived and/or modified CDS sequence (opt3) from HTNV(Aa09-1000)__KT935001.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctggtctccaaacagaatcggttccgcttgacggagcaacaggtgaactttgtttgtcaaagagtggatgtagacatcgtcgtgtactgcaacggacagaggaaggttattctcaccaagacactggtgatcggtcagtgtatttatactataacctctttattctcgctgctccccggcgtcgcccacagcatcgcggtggaactttgcgtaccagggtttcatggatgggccacagcagctctgttggtgactttctgttttggctgggttctaattcctgccatcaccttcatcattctgacaatactcaaatttatcgctaatattttccacacctccaaccaagagaatcggctgaagtcagtccttcgcaaaatcaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaacttcaccccaggctgttacaggactctcaatctgtttcggtataagtcccgttgctacattttcacaatgtggatctttttactggtactagagtcaatactctgggcggcaagcgcctctgagacgccgctgacccccgtctggaacgacaatgctcacggagtgggctccgttcctatgcatactgatcttgaattggacttcagtctgacatctagctccaagtacacctatcgcagaaaactcacaaacccactggaggaagcccagtcaatcgatcttcacattgagatcgaggaacagactattggggtggacgtccatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtgggcactggttgcaccgcctgcgggctgtacttagatcgactgaaacccgttggctccgcatacaagatcataacaattcgctattctagaagggtgtgtgtacagtttggagaagagaatctatgcaagatcattgacatgaacgattgtttcgtcagccggcatgtgaaagtgtgcatcataggcactgtctcaaagtttagtcagggggacaccctcctgttctttggaccgcttgagggtggcgggttgatcttcaaacactggtgtacgtccacatgccagtttggagatcctggcgacattatgtctccacgcgataagggtttcctgtgtcccgagttccctgggagctttagaaagaagtgcaatttcgcgaccactcccatctgtgaatacgacggcaacatggtttccggatataaaaaggtgatggctacaattgattcatttcagagcttcaataccagtactatgcattttaccgacgaaaggatcgagtggaaggatccagacggcatgctccgtgatcacataaacattctggtaacaaaagacatcgacttcgataacttaggggaaaatccttgcaagatcggactgcagacgtcttccattgagggcgcctggggtagcggggtgggatttacccttacttgtttggtctcgctcacagagtgccccaccttcctgacatcaatcaaagcatgcgacaaggccatttgttacggcgctgaatctgtgactctaacccggggtcagaacacggttaaagtgagtggcaaagggggacactccggcagcacatttaagtgctgtcatggggaggattgctctcagataggactgcacgccgcagctccacatctcgacaaggtcaatggcatcagcgaaatggagaactccaaggtgtatgatgacggtgccccgcaatgtgggattaaatgctggttcgttaagtcaggagaatggatcagtggcatttttagcggtaattggatcgtgctgatagtcctttgtgtattcttgctgttctctttagtgctcctgtccatcctttgccctgttcgaaaacacaagaagtcatga

SEQ ID NO: 10040 - RNA, 3408 nt, synthetic construct
  misc_feature 1..3408: note = derived and/or modified CDS sequence (opt3) from HTNV(Aa09-948)__KT935000.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaaaagctgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagtacctgtaacgacacagagaataaggtgcaaggatactatatttgcatcgtcggcggcaactctgcccccatttacgtgcctactctggatgacttcagatccatggaagcatttaccgggatcttcaggagcccacacggagaggatcacgacctcgctggtgaagagacagccacctattcgatcgtaggcccggctaatgccaaagttccccattctgcgtcctcagatacgttaagtctgattgcatttagcgggataccttcctactctagcctttcaatcttgactagctccacagaagccaagcacgtgttcagcccaggactgtttcccaaactaaaccataccaattgcgacaagggcgctattcctctcatgtggactggtatgatcgacctgccagggtattacgaggccatacacccctgtacagtcttctgcgtgctttctggaccgggcgcatcatgtgaggctttcagtgaaggcgggatttttaacatcaccagccctatgtgcctgatctccaaacagaatcggttccgcttgacggagcagcaggtcaactttgtgtgtcaaagagttgatgtggacattgtagtctactgcaacggacagaggaaggtgatcctcaccaagacactggttattggtcagtgtatatatactatcacctctttattctcgctgctccccggcgtggcccacagcattgcggtcgaactttgcgtgccagggtttcatggatgggccacagcagctctgttggtaactttctgttttggctgggtgctaatccctgccatcaccttcattatactgacaatcctcaaatttattgctaatatcttccacacctccaaccaagagaatcggctgaagtcagttcttcgcaaaattaaggaagagtttgagaaaactaagggtagtatggtctgcgatgtgtgtaagtacgaatgcgagacgtataaagaactgaaggcccatggggtgtcttgcccccagagccagtgtccatactgcttcacacactgtgagcccaccgaagcagcctttcaggctcattataaagtctgccaagttactcaccgattcagagacgatttgaagaaaaccgtgacacctcagaacttcaccccaggctgttacaggactctcaatctgtttcggtataagtcccgttgctacatcttcacaatgtggatatttttactggtgctagagtcaatcctctgggcggcaagcgcctctgagacgccgctgacccccgtatggaacgacaatgctcacggagtcggctccgtgcctatgcatactgatcttgaattggacttcagtctgacaagcagctccaagtacacctatcgcagaaaactcacaaacccactggaggaagcccagtcaattgatcttcacatcgagattgaggaacagactatcggggttgacgtgcatgcactgggacactggtttgatggtaggttgaatctcaagaccagtttccactgttacggcgcctgcacgaaatatgagtacccctggcataccgctaagtgtcactatgaacgggactaccaatatgagacaagctgggggtgcaacccttcggactgtccaggagtcggcactggttgcaccgcctgcgggctgtacttagatcgactgaaacccgtgggctccgcatacaagataattacaatccgctattctagaagggtttgtgtgcagtttggagaagagaatctatgcaagattatcgacatgaacgattgtttcgtaagccggcatgtcaaagtgtgcataatcggcactgtgtcaaagtttagtcagggggacaccctcctgttctttggaccgcttgagggtggcgggttgattttcaaacactggtgtacgtccacatgccagtttggagatcctggcgacatcatgtctccacgcgataagggtttcctgtgtcccgagttccctgggagctttagaaagaagtgcaatttcgcgaccactcccatttgtgaatacgacggcaacatggtctccggatataaaaaggttatggctacaatcgattcatttcaatctttcaataccagtactatgcattttaccgacgaaaggatagagtggaaggatccagacggcatgctccgtgatcacattaacatcctggtgacaaaagacatcgacttcgataacttaggggaaaatccttgcaagattggactgcagacgtcttccatcgagggcgcctggggtagcggggtaggatttacccttacttgtttggtgtcgctcacagagtgccccaccttcctgacatcaattaaagcatgcgacaaggccatatgttacggcgctgaatctgtcactctaacccggggtcagaacacggtgaaagttagtggcaaagggggacactccggcagcacatttaagtgctgtcatggggaggattgctctcagatcggactgcacgccgcagctccacatctcgacaaggtgaatggcattagcgaaatggagaactccaaggtctatgatgacggtgccccgcaatgtgggatcaaatgctggttcgtgaagtcaggagaatggattagtggcatctttagcggtaattggatagttctgatcgtgctttgtgtcttcttgctgttctctttagtactcctgtccattctttgccctgtgcgaaaacacaagaagtcatga

SEQ ID NO: 10041 - RNA, 3408 nt, synthetic construct
  misc_feature 1..3408: note = derived and/or modified CDS sequence (opt3) from HTNV(Aa10-434)__KT935004.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcgggggaaattctgtgataggttatgtcgaattgccaccgatgcccttagctgatactgcacagctggtgcctgagtcaagttgtagcatggacaaccatcaatccctaaatacgatcaccaagtacacacaggtttcttggaggggcaaagccgatcagtcgcagtcaagccaaattagttttgaaactgtgtccaccgaggtcgacctcaaggggacatgcgtgctgaaacacaagatggtagaagagtcttatcggagccgcaagtccatcacctgttacgatctttcatgcaacagtacttattgtaaaccaacactgtacatgattgttcccatccatgcgtgcaatatgatgaaaagctgtttgatagctctcggaccttatcgagtgcaggtcgtgtacgagcgtacctactgcatgacgggcgtgctgatcgaaggtaaatgtttcgtcccagaccagtctgttgtgtccattatcaagcacgggatttttgatatcgcctcagtacatatagtgtgcttctttgtcgcagtgaaaggaaacacttataagattttcgagcaggttaagaaaagttttgaaagtacctgtaatgacacagagaacaaggtgcaaggctactatatctgcattgtcggcgggaatagcgcccccatctacgtgcctactctggatgacttcagatccatggaggcttttaccggaatcttcaggagcccacacggtgaagatcacgacctcgcaggcgaggaaacagccacctattcgattgtagggccggctaacgccaaagttccccattctgcgtcctcagatacgttaagtctgatagcatttagcggaatcccttcctactctagcctttcaattttgactagctccacagaggccaagcacgtgttcagcccaggcctgtttcccaaactaaatcataccaactgcgacaagggtgctatccctctcatgtggactgggatgatagacctgccaggatattacgaagccattcacccctgtacagtcttctgcgtgctttctggcccgggcgcatcatgtgaggctttcagtgaagggggaatctttaatatcaccagccctatgtgcctggtctccaaacagaaccggttccgcttgacggagcaacaggtgaattttgtttgtcaaagagtggatgtagacattgtcgtgtactgcaacggtcagaggaaggttatcctcaccaagacactggtgattggccagtgtatatatactatcacctctttattctcgctgctccccggggtcgcccacagcattgcggtggagctttgcgtaccaggatttcatggctgggccacagcagctctgttggtgactttctgttttggttgggttctaatccctgccatcaccttcattatactgacaatcctcaaatttattgctaacatcttccacacctccaatcaagaaaaccggctgaagtcagtccttcgcaaaattaaggaggaatttgagaaaactaaggggagtatggtgtgcgatgtgtgtaagtacgagtgcgaaacgtataaagagctgaaggcccatggcgtctcttgcccccagagccagtgtccatactgcttcacacactgtgaacccaccgaggcagcctttcaggctcattataaagtttgccaagtgactcaccgattcagagacgatttgaagaaaaccgtgacacctcagaatttcaccccaggatgttacaggactctcaacctgtttcggtataagtcccgttgctacatcttcacaatgtggatatttttactggtactagaatcaatcctctgggcggcaagcgcctctgagacgccgctgacccccgtctggaatgacaacgctcacggcgtggggtccgttcctatgcatactgatcttgagttggacttcagtctgacatcttcttccaagtacacctatcgcagaaaactcacaaatccactggaagaggcccagtcaattgatcttcacatcgaaattgaggagcagactatcggagtggacgtccatgcactgggtcactggtttgatggcaggttgaacctcaagaccagtttccactgttacggggcctgcacgaaatatgaatacccctggcataccgctaagtgtcactatgagcgggactaccaatatgaaacaagctggggatgcaatccttcggactgtccaggcgtgggtactgggtgcaccgcctgcggcctgtacttagatcgactgaaacccgttggatccgcatacaagataattacaatccgctattctagaagggtgtgtgtacagtttggcgaggaaaacctatgcaagattatcgacatgaatgattgtttcgtcagccggcatgtgaaagtgtgcataatcgggactatttcaaagtttagtcagggagacaccctcctgttctttggtccgcttgagggcgggggattgatcttcaaacactggtgtacgtccacatgccagtttggcgatcctggtgacattatgtctccacgcgataaggggttcctgtgtcccgagttccctggcagctttagaaagaagtgcaacttcgcgaccactcccatctgtgaatacgacggaaatatggtctccggctataaaaaggttatggctacaatagattcatttcagagcttcaacaccagtactatgcattttaccgacgagaggattgaatggaaggatccagacgggatgctccgtgatcacatcaatatcctggtgacaaaagacattgacttcgataacttaggagagaacccttgcaagatcggcctgcaggcctcttccattgaaggtgcatgggggagcggagtaggctttacgcttacctgtttggtgtcgctcactgagtgccccacattcctgacctcaataaaagcctgcgacaaggctatctgttacggtgccgagtctgtcacactaactcggggccagaataccgtgaaagttagtgggaagggaggccactccgggagcacgtttaagtgctgtcatggagaagattgctctcagattggcctgcacgcagctgccccacatctcgacaaagtgaacggtatcagcgagatggaaaattccaaggtctatgatgacggggcgccgcaatgtggaattaaatgctggttcgtgaagtcaggcgagtggatcagtggtatatttagcggcaactggatcgttctgattgtgctttgtgtcttcttgctgttctctttagtactcctgtccatcctttgccctgtgcgaaaacacaagaagtcatga

SEQ ID NO: 10042 - RNA, 3408 nt, synthetic construct
  misc_feature 1..3408: note = derived and/or modified CDS sequence (opt3) from HTNV(Aa10-518)__KT935005.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgagactgtgtccaccgaagtcgacctcaagggcacatgcgtgctgaaacacaagatggtagaggagtcttatcggagccgcaagtccattacctgttacgatctttcatgcaatagtacttattgtaaaccaacactgtacatgatcgttcccattcatgcgtgcaacatgatgaagagttgtttgatcgctctcgggccttatcgagtgcaggtcgtgtacgaacgtacctactgcatgacgggagtgctgatagagggcaaatgtttcgtcccagaccagtctgttgtgtccatcattaagcacggtatctttgatattgcctcagtacatatcgtgtgcttctttgtcgcagtgaaagggaatacttataagatattcgaacaggttaagaaatcttttgagagtacctgtaacgacacaaagaataaagtgcaaggatactatatttgcatcgtcggcggcaactctgcccccatttacgtgcctactctggatgacttcagatccatggaggcttttaccgggatcttcaggagcccacacggagaagatcacgacctcgcaggggaggaaacagccacctattcgatcgtaggcccggctaatgccaaggttccccattctgcgtcctcagatacgttaagtctgattgcatttagcgggataccttcctactctagcctttcaatcttgactagctccacagaggccaaacacgtgttcagcccaggactgtttcccaagctaaaccataccaattgcgacaaaggcgctattcctctcatgtggactggtatgatcgacctgccagggtattacgaagccatacacccctgtacagtcttctgcgtgctttctggaccgggcgcatcatgtgaggctttcagtgagggcgggatttttaacatcaccagccctatgtgcctggtctccaagcagaatcggttccgcttgacggaacaacaggtgaactttgtttgtcaaagagtggatgtagacatcgtcgtgtactgcaacggacagaggaaggttattctcaccaaaacactggtgatcggtcagtgtatttatactataacctctttattctcgctgctccccggcgtcgcccacagcatcgcggtggagctttgcgtaccagggtttcatggatgggccacagcagctctgttggtgactttctgttttggctgggttctaattcctgccatcaccttcatcattctgacaatactcaagtttatcgctaatattttccacacctccaaccaagaaaatcggctgaaatcagtccttcgcaagatcaaagaggaatttgagaagactaagggtagtatggtgtgcgatgtgtgtaaatacgagtgcgaaacgtataaggagctgaaagcccatggggtctcttgcccccagagccagtgtccatactgcttcacacactgtgaacccaccgaggcagcctttcaggctcattataaggtttgccaagtgactcaccgattcagagacgatttgaaaaagaccgtgacacctcagaacttcaccccaggctgttacaggactctcaatctgtttcggtataagtcccgttgctacattttcacaatgtggatctttttactggtactagaatcaatactctgggcggcaagcgcctctgagacgccgctgacccccgtctggaacgacaatgctcacggagtgggctccgttcctatgcatactgatcttgagttggacttcagtctgacaagcagctccaaatacacctatcgcagaaagctcacaaacccactggaagaggcccagtcaatcgatcttcacattgaaatcgaggagcagactattggggtggacgtccatgcactgggacactggtttgatggtaggttgaatctcaaaaccagtttccactgttacggcgcctgcacgaagtatgaatacccctggcataccgctaaatgtcactatgagcgggactaccaatatgaaacaagctgggggtgcaacccttcggactgtccaggagtgggcactggttgcaccgcctgcgggctgtacttagatcgactgaagcccgttggctccgcatacaagatcataacaattcgctattctagaagggtgtgtgtacagtttggagaggaaaatctatgcaaaatcgtcgacatgaacgattgtttcgtgagccggcatgtgaaggtctgcattatcggcactgtttcaaaatttagtcagggggacaccctcctgttctttggaccgcttgagggtggcgggttgatattcaagcactggtgtacgtccacatgccagtttggagatcctggcgacatcatgtctccacgcgataaaggtttcctgtgtcccgagttccctgggagctttagaaagaaatgcaatttcgcgaccactcccatttgtgaatacgacggcaacatggtgtccggatataagaaggtaatggctacaatcgattcatttcagagcttcaataccagtactatgcattttaccgacgagaggattgaatggaaagatccagacggcatgctccgtgatcacatcaacatactggtgacaaaggacattgacttcgataacttaggggagaatccttgcaaaatcggactgcagacgtcttccatcgaaggcgcctggggtagcggggtcggatttacccttacttgtttggtgtcgctcacagagtgccccaccttcctgacatcaattaaggcatgcgacaaagccatctgttacggcgctgagtctgttactctaacccggggtcagaacacggtgaaggtcagtggcaagggtggacactccggcagcacatttaaatgctgtcatggggaagattgctctcagattggactgcacgccgcagctccacatctcgacaaggtgaatggcataagcgagatggaaaactccaaagtttatgatgacggtgccccgcaatgtgggatcaagtgctggttcgtgaaatcaggagagtggattagtggcatctttagcggtaattggattgtcctgatcgtactttgtgtgttcttgctgttctctttagttctcctgtccatactttgccctgtgcgaaagcacaagaaatcatga

SEQ ID NO: 10043 - RNA, 3408 nt, synthetic construct
  misc_feature 1..3408: note = derived and/or modified CDS sequence (opt3) from HTNV(Aa10-561)__KT935006.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaattagttttgagactgtgtccaccgaagtcgacctcaagggcacatgcgtgctgaaacacaagatggtagaggagtcttatcggagccgcaagtccatcacctgttacgatctttcatgcaacagtacttattgtaaaccaacactgtacatgattgttcccatccatgcgtgcaatatgatgaaaagctgtttgatagctctcgggccttatcgagtgcaggtcgtgtacgaacgtacctactgcatgacgggagtgctgatcgagggcaaatgtttcgtcccagaccagtctgttgtgtccattatcaagcacggtatttttgatatcgcctcagtacatatagtgtgcttctttgtcgcagtgaaagggaacacttataagattttcgaacaggttaagaaaagttttgagagtacctgtaatgacacagagaacaaggtgcaaggatactatatctgcattgtcggcggcaattctgcccccatctacgtgcctactctggatgacttcagatccatggaagcatttaccgggatcttcaggagcccacacggagaggatcacgacctcgctggtgaagagacagccacctattcgattgtaggcccggctaacgccaaagttccccattctgcgtcctcagatacgttaagtctgatagcatttagcgggatcccttcctactctagcctttcaattttgactagctccacagaagccaagcacgtgttcagcccaggactgtttcccaaactaaatcataccaactgcgacaagggcgctatccctctcatgtggactggtatgatagacctgccagggtattacgaggccattcacccctgtacagtcttctgcgtgctttctggaccgggcgcatcatgtgaggctttcagtgaaggcgggatctttaatatcaccagccctatgtgcctggtctccaaacagaaccggttccgcttgacggagcaacaggtgaattttgtttgtcaaagagtggatgtagacattgtcgtgtactgcaacggacagaggaaggttatcctcaccaagacactggtgattggtcagtgtatatatactatcacctctttattctcgctgctccccggcgtcgcccacagcattgcggtggaactttgcgtaccagggtttcatggatgggccacagcagctctgttggtgactttctgttttggctgggttctaatccctgccatcaccttcattatactgacaatcctcaaatttattgctaacatcttccacacctccaatcaagagaaccggctgaagtcagtccttcgcaaaattaaggaagagtttgagaaaactaagggtagtatggtgtgcgatgtgtgtaagtacgaatgcgagacgtataaagaactgaaggcccatggggtctcttgcccccagagccagtgtccatactgcttcacacactgtgagcccaccgaagcagcctttcaggctcattataaagtttgccaagtgactcaccgattcagagacgatttgaagaaaaccgtgacacctcagaatttcaccccaggctgttacaggactctcaacctgtttcggtataagtcccgttgctacatcttcacaatgtggatatttttactggtactagagtcaatcctctgggcggcaagcgcctctgagacgccgctgacccccgtctggaatgacaacgctcacggagtgggctccgttcctatgcatactgatcttgaattggacttcagtctgacatctagctccaagtacacctatcgcagaaaactcacaaatccactggaggaagcccagtcaattgatcttcacatcgagattgaggaacagactatcggggtggacgtccatgcactgggacactggtttgatggtaggttgaacctcaagaccagtttccactgttacggcgcctgcacgaaatatgagtacccctggcataccgctaagtgtcactatgaacgggactaccaatatgagacaagctgggggtgcaatccttcggactgtccaggagtgggcactggttgcaccgcctgcgggctgtacttagatcgactgaaacccgttggctccgcatacaagataattacaatccgctattctagaagggtgtgtgtacagtttggagaagagaacctatgcaagattatcgacatgaatgattgtttcgtcagccggcatgtgaaagtgtgcataatcggcactatttcaaagtttagtcagggggacaccctcctgttctttggaccgcttgagggtggcgggttgatcttcaaacactggtgtacgtccacatgccagtttggagatcctggcgacattatgtctccacgcgataagggtttcctgtgtcccgagttccctgggagctttagaaagaagtgcaacttcgcgaccactcccatctgtgagtacgacggcaatatggtctccggatataaaaaggttatggctacaatagattcatttcagagcttcaacaccagtactatgcattttaccgacgaaaggattgagtggaaggatccagacggcatgctccgtgatcacatcaatatcctggtgacaaaagacattgacttcgataacttaggggaaaacccttgcaagatcggactgcaggcctcttccattgagggcgcatggggtagcggggtaggatttacgcttacctgtttggtgtcgctcactgagtgccccacattcctgacctcaataaaagcctgcgacaaggctatctgttacggcgccgaatctgtcacactaactcggggtcagaataccgtgaaagttagtggcaaagggggacactccggcagcacgtttaagtgctgtcatggggaggattgctctcagattggactgcacgcagctgccccacatctcgacaaggtgaacggcatcagcgaaatggaaaattccaaggtctatgatgacggtgcgccgcaatgtgggattaaatgctggttcgtgaagtcaggagaatggatcagtggcatatttagcggtaactggatcgttctgattgtgctttgtgtcttcttgctgttctctttagtactcctgtccatcctttgccctgtgcgaaaacacaagaagtcatga

SEQ ID NO: 10044 - RNA, 3408 nt, synthetic construct
  misc_feature 1..3408: note = derived and/or modified CDS sequence (opt3) from HTNV(Aa14-172)__KT935008.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttaactgatacggctcagctggtgcctgaatcaagttgtagcatggacaaccatcaatccctaaataccatcacaaagtacactcaggtttcttggaggggtaaagcagatcagtcgcagtcaagccaaaacagttttgagaccgtgtccacagaagtcgacctcaagggcacttgcgtgctgaaacacaagatgattgaggagtcttatcggagccgcaagtccatcacttgttacgatctttcatgcaataacacatattgtaaaccaaccctgtacatgattgtacccatccatgcctgcaatatgatgaagagttgtttgatagcgctcgggccttatcgagttcaggtggtctacgaacgtacgtactgcatgactggagtgctgatcgagggcaaatgtttcgtgccagaccagagcgtcgtttctattatcaagcacggtatttttgatatcgcttccgtgcatatagtatgcttctttgtggccgtcaaagggaacacctataagattttcgaacaggtgaagaaatcatttgagagcacatgtaatgacactgagaacaaggttcaaggatactatatctgcattgtgggcggcaatagtgcacccatctacgtccctaccctggatgacttcagatctatggaagcctttacagggatcttcaggtccccacacggagaggatcacgacctcgctggtgaagagaccgcaacgtatagcattgtgggcccggccaacgctaaagtaccccattcggcctcttccgatactttatcactgatagcgtttagtgggatccctagctactcctctcttagcattttgacatcaagtaccgaagcaaagcacgttttctccccaggactgtttcccaaactaaatcatactaactgcgacaagggcgccatccctctcatgtggacaggtatgatagacctgccagggtattacgaggctattcacccctgtaccgtgttctgcgtccttagcggaccgggcgcctcttgtgaggcattctcagaaggcgggatctttaatatcacgagtcctatgtgcctggtgagcaaacagaaccggttccgcttgaccgagcagcaggtcaactttgtgtgtcaaagagttgatgtggacattgtagtctactgcaatggacagaggaaggtgatcctcacaaagactctggttattggtcagtgtatatataccatcacatccttattctctctgctccccggcgtggctcactcgattgccgtcgaactttgcgtgccagggtttcatggatgggcgactgccgcactgttggtaaccttctgttttggctgggtgctaatccctgctatcacattcattatactgaccatcctcaaatttattgccaacatcttccacactagcaatcaagagaaccggctgaagtccgttcttcgcaaaattaaggaagagtttgagaaaacgaagggttcaatggtctgcgatgtgtgtaagtacgaatgcgagacatataaagaactgaaggctcatggggtgagttgcccccagtctcagtgtccatactgcttcacccactgtgagcccactgaagccgcatttcaggcccattataaagtctgccaagttacccaccgattcagagacgatttgaagaaaacagtgacccctcagaatttcactccaggctgttacaggacactcaacctgtttcggtataagagccgttgctacatcttcacgatgtggatatttttactggtgctagagtccatcctctgggctgcgtcagcaagcgagaccccgctgactcccgtatggaatgacaacgcccacggagtcggctctgtgcctatgcatacagatcttgaattggacttctccctgaccagtagctctaagtacacatatcgcagaaaactcactaatccactggaggaagctcagtccattgatcttcacatcgagattgaggaacagaccatcggggttgacgtgcatgccctgggacactggtttgatggtaggttgaacctcaagacgtcattccactgttacggcgcatgcaccaaatatgagtacccctggcatacagccaagtgtcactatgaacgggactaccaatatgagaccagttgggggtgcaatcctagcgactgtccaggagtcggcaccggttgcacagcttgcgggctgtacttagatcgactgaaacccgtgggctcggcctacaagataattactatccgctattccagaagggtttgtgtgcagtttggagaagagaacctatgcaagattatcgacatgaatgattgtttcgtatctcggcatgtcaaagtgtgcataatcggcaccgtgagcaagttttcacagggggacacgctcctgttctttggaccgcttgagggtggcgggttgattttcaaacactggtgtacaagtacctgccagtttggagatcctggcgacatcatgtccccacgcgataagggtttcctgtgtcccgagttccctgggtcttttagaaagaagtgcaacttcgcaactacacccatttgtgaatacgacggcaatatggtcagcggatataaaaaggttatggcgaccatcgattcctttcaatcattcaacactagcaccatgcattttacagacgaaaggatagagtggaaggatccagacggcatgctccgtgatcacattaacatcctggtgacgaaagacatcgacttcgataatttaggggaaaacccttgcaagattggactgcagaccagttctatcgagggcgcttggggttccggggtaggatttactcttacatgtttggtgagcctcaccgagtgccccacattcctgacttcgattaaagcctgcgacaaggcaatatgttacggcgccgaatcagtcaccctaacgcggggtcagaatacagtgaaagtttctggcaaagggggacacagtggctccacctttaagtgctgtcatggggaggattgcagccagatcggactgcacgctgccgcaccacatctcgacaaagtgaacggcatttctgaagtcgagaatagcaaggtgtatgatgacggtgctccgcaatgtgggatcaaatgctggttcgttaagtccggagaatggatttcaggcatctttagtggtaactggatagtgctgatcgtcctttgtgtattcttgctgttcagcttagtgctcctgtctattctttgccctgttcgaaaacacaagaagtcctga

SEQ ID NO: 10045 - RNA, 3408 nt, synthetic construct
  misc_feature 1..3408: note = derived and/or modified CDS sequence (opt3) from HTNV(Aa14-266)__KT935013.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagatggtgcctgaatcaagttgtagcatggacaaccatcaatccctgaatacgatcaccaagtacacacaggtttcttggaggggtaaagccgatcagtcgcagtcaaaccaaaatagctttgagactgtgagtaccgaagtcgacctaaagggcacatgcgtgctcaaacacaagatggtagaggagtcctatcggtctcgcaagagcattacctgttacgatctgtcctgcaactcaacttattgtaaaccaacactttacatgatcgttcccattcatgcgtgcaatatgatgaagagttgtctgatcgctttggggccttatcgagtgcaggtcgtgtacgaacgtacctactgcatgacgggagtgctcatagagggcaaatgtttcgtcccagaccagagcgttgtgtctatcattaagcacggtatctttgatattgcctccgtacatatcgtgtgcttctttgtcgcagtgaaagggaacacttataagatattcgaacaggttaagaaatcatttgagagcacctgtaatgacacagagaacaaggtgcaaggatactatatttgcatcgtcggcggcaatagtgcccccatttacgtgcctactctggatgacttcagatctatggaggcttttaccgggatcttcaggtccccacacggagaggatcacgacctggctggtgaagagatcgccacatatagcattgtaggcccggctaacgccaaagttccccattcggcgtcttccgataccctctcattaatagcatacagtgggatccctagctattcctctctgagcattcttacgtcaagtactgaagccaagcacgtgttttccccaggattgttccccaaactgaatcatacaaactgcgacaagagcgctatccctctaatgtggaccggcatgatagacctcccaggttactacgaggccgtccacccctgtactgtgttttgcgtcctgtctgggccgggagcatcatgtgaggctttcagtgaaggcggcattttcaatatcacaagccctatgtgccttgtgtccaaacagaaccggtttcgcctgaccgagcagcaggttaacttcgtgtgtcaaagagtagatgtcgacatcgtggtttattgcaatgggcagaggaaggtgattttgacgaagaccctcgtcatcggacagtgtatttacacaataacttctctgttttcgttactgcccggtgtggcccacagcatcgcggtagaactctgcgtgccaggcttccatgggtgggccaccgcagcacttctggttacattttgtttcggatgggtcttgattcctgccatcacttttatcattctaaccatactgaaattcatcgctaacatttttcacacatccaatcaagagaaccggctcaagtcagtgctgcgcaaaatcaaggaagagttcgagaaaaccaagggcagtatggtgtgcgatgtctgtaagtatgaatgcgagacttacaaagaacttaaggcccatggtgtttcttgcccccagagccagtgtccatattgctttacgcactgtgagcccacagaagcagccttccaggctcattacaaagtgtgccaagtgacccaccgatttagagacgatctgaagaaaactgtaacccctcagaatttcacaccagggtgttataggaccttgaacctcttccggtacaagtcccgttgctacatttttactatgtggatcttcctgttagtcctggagtcaatactatgggcggcaagcgcctctgagacaccgctcacgcccgtgtggaatgacaacgctcacggcgttggatccgtgcctatgcataccgatctggaacttgactttagtttgactagcagttccaagtatacataccgcagaaaactgaccaatccactcgaggaagcccagtcaatcgatctgcacattgagatcgaggaacagacaattggcgtcgacgtgcatgcacttgggcactggttcgatggaaggctgaacttgaagacttcttttcactgttatggtgcctgcaccaaatacgagtatccctggcatacggctaagtgtcactacgaacgggactatcaatacgagaccagctggggctgcaatccttcggactgtccaggggttggaacaggctgcactgcctgcggtctctacctggatcagttaaaacccgtggggtccgcatataagatcataaccattcgatactctcgcagagtatgtgtccagttcggcgaagagaacctgtgcaagacaatcgacatgaatgattgttttgtgagcaggcatgtgaaagtctgcattatcggaactgtttcaaagttcagtcagggcgacaccctactctttttcgggccgctggagggaggtggccttatatttaaacactggtgtacgtccacatgccaattcggggatcctggagacatcatgtctccacgggataagggctttttgtgtcccgagttccctggtagcttccgcaaaaagtgcaactttgcgaccactcccatttgtgaatatgacgggaatatggtgtccggctacaaaaaggtaatggctacaatcgattcattccagagctttaacaccagtactatgcatttcaccgacgaaagaattgagtggaaggatccagacggaatgctgagggatcacatcaacatactcgtgacaaaagacattgactttgataatctgggcgaaaacccttgcaagatcgggttacagacgtcttccatcgagggagcctggggcagcggtgtcgggttcaccctgacttgtcttgtgtcgttgacagagtgccccacctttctcacatcaattaaagcatgcgacaaggccatctgttatggagctgaatctgttactctgacccgtggccagaatacggtgaaagtcagtggtaagggcgggcactccggaagcacattcaagtgctgtcatggcgaggattgctctcaaattgggctacacgccgcagctccacatctggacaaagtgaacggaataagcgaaatggaaaattccaaggtttacgatgacggcgccccgcagtgtggtatcaaatgctggtttgtgaagtcaggggaatggattagtggaatcttcagcggcaactggattgtcctcatcgtactgtgtgtgtttcttttgttctctctggttttactctccatactgtgccctgtgcggaaacacaagaagtcatga

SEQ ID NO: 10046 - RNA, 3408 nt, synthetic construct
  misc_feature 1..3408: note = derived and/or modified CDS sequence (opt3) from HTNV(Aa14-272)__KT935014.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagatggtgcctgaatcaagttgtagcatggacaaccatcaatccctgaatacgatcaccaagtacacacaggtttcttggaggggtaaagccgatcagtcgcagtcaaaccaaaatagctttgagactgtgagtaccgaagtcgacctaaagggcacatgcgtgctcaaacacaagatggtagaggagtcctatcggtctcgcaagagcattacctgttacgatctgtcctgcaactcaacttattgtaaaccaacactttacatgatcgttcccattcatgcgtgcaatatgatgaagagttgtctgatcgctttggggccttatcgagtgcaggtcgtgtacgaacgtacctactgcatgacgggagtgctcatagagggcaaatgtttcgtcccagaccagagcgttgtgtctatcattaagcacggtatctttgatattgcctccgtacatatcgtgtgcttctttgtcgcagtgaaagggaacacttataagatattcgaacaggttaagaaatcatttgagagcacctgtaatgacacagagaacaaggtgcaaggatactatatttgcatcgtcggcggcaatagtgcccccatttacgtgcctactctggatgacttcagatctatggaggcttttaccgggatcttcaggtccccacacggagaggatcacgacctggctggtgaagagatcgccacatatagcattgtaggcccggctaacgccaaagttccccattcggcgtcttccgataccctctcattaatagcatacagtgggatccctagctattcctctctgagcattcttacgtcaagtactgaagccaagcacgtgttttccccaggattgttccccaaactgaatcatacaaactgcgacaagagcgctatccctctaatgtggaccggcatgatagacctcccaggttactacgaggccgtccacccctgtactgtgttttgcgtcctgtctgggccgggagcatcatgtgaggctttcagtgaaggcggcattttcaatatcacaagccctatgtgccttgtgtccaaacagaaccggtttcgcctgaccgagcagcaggttaacttcgtgtgtcaaagagtagatgtcgacatcgtggtttattgcaatgggcagaggaaggtgattttgacgaagaccctcgtcatcggacagtgtatttacacaataacttctctgttttcgttactgcccggtgtggcccacagcatcgcggtagaactctgcgtgccaggcttccatgggtgggccaccgcagcacttctggttacattttgtttcggatgggtcttgattcctgccatcacttttatcattctaaccatactgaaattcatcgctaacatttttcacacatccaatcaagagaaccggctcaagtcagtgctgcgcaaaatcaaggaagagttcgagaaaaccaagggcagtatggtgtgcgatgtctgtaagtatgaatgcgagacttacaaagaacttaaggcccatggtgtttcttgcccccagagccagtgtccatattgctttacgcactgtgagcccacagaagcagccttccaggctcattacaaagtgtgccaagtgacccaccgatttagagacgatctgaagaaaactgtaacccctcagaatttcacaccagggtgttataggaccttgaacctcttccggtacaagtcccgttgctacatttttactatgtggatcttcctgttagtcctggagtcaatactatgggcggcaagcgcctctgagacaccgctcacgcccgtgtggaatgacaacgctcacggcgttggatccgtgcctatgcataccgatctggaacttgactttagtttgactagcagttccaagtatacataccgcagaaaactgaccaatccactcgaggaagcccagtcaatcgatctgcacattgagatcgaggaacagacaattggcgtcgacgtgcatgcacttgggcactggttcgatggaaggctgaacttgaagacttcttttcactgttatggtgcctgcaccaaatacgagtatccctggcatacggctaagtgtcactacgaacgggactatcaatacgagaccagctggggctgcaatccttcggactgtccaggggttggaacaggctgcactgcctgcggtctctacctggatcagttaaaacccgtggggtccgcatataagatcataaccattcgatactctcgcagagtatgtgtccagttcggcgaagagaacctgtgcaagatcattgacatgaatgattgttttgtgagcaggcatgtgaaagtctgcatcataggaacagtttcaaagttcagtcagggcgacactctactctttttcgggccgctggagggaggtggccttatctttaaacactggtgtacctccacgtgccaattcggggatcctggagacattatgtctccacgggataagggctttttgtgtcccgagttccctggtagcttccgcaaaaagtgcaactttgcgacaacccccatctgtgaatatgacgggaatatggtgtccggctacaaaaaggtaatggctactattgattcattccagagctttaacacaagtaccatgcatttcactgacgaaagaatcgagtggaaggatccagacggaatgctgagggatcacataaacattctcgtgaccaaagacatcgactttgataatctgggcgaaaacccttgcaagatcgggttacagacatcttccattgagggagcctggggcagcggtgtcgggttcacgctgacctgtcttgtgtcgttgactgagtgccccacatttctcacctcaatcaaagcatgcgacaaggccatttgttatggagctgaatctgttacactgactcgtggccagaataccgtgaaagtcagtggtaagggcgggcactccggaagcacgttcaagtgctgtcatggcgaggattgctctcaaatagggctacacgccgcagctccacatctggacaaagtgaacggaatcagcgaaatggaaaattccaaggtttacgatgacggcgccccgcagtgtggtattaaatgctggtttgtgaagtcaggggaatggatcagtggaattttcagcggcaactggatcgtcctcatagtactgtgtgtgtttcttttgttctctctggttttactctccatcctgtgccctgtgcggaaacacaagaagtcatga

SEQ ID NO: 10047 - RNA, 3408 nt, synthetic construct
  misc_feature 1..3408: note = derived and/or modified CDS sequence (opt3) from HTNV(Aa14-362)__KT935015.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggggtaaagccgatcagtcgcagtcaagccaaaacagttttgaggcggtgtccactgaagtcgacctcaaggggacctgcgtgctgaaacacaagatggtagaggagtcttatcggagccgcaagtccattacatgttacgatctttcatgcaatagtacctattgtaaaccaactctgtacatgatcgttcccattcatgcttgcaacatgatgaaaagctgtttgatcgccctcgggccttatcgagtgcaggtcgtgtacgaacgtacatactgcatgaccggagtgctgatagagggcaaatgtttcgtcccagaccagtctgttgtgtccatcattaagcacggtatctttgatattgcatcagtacatatcgtgtgcttctttgtcgccgtgaaagggaatacgtataagatattcgaacaggttaagaaaagttttgagagtacttgtaacgacaccgagaataaggtgcaaggatactatatttgcatcgtcggcggcaactctgctcccatttacgtgcctacactggatgacttcagatccatggaagcatttactgggatcttcaggagcccacacggagaggatcacgacctcgccggtgaagagaccgctacatattcgatcgtaggcccggccaatgcgaaagttccccattctgcatcctcagataccttaagtctgattgcctttagcgggataccttcctactctagcctttcaatcttgacgagttccactgaagctaagcacgtgttcagcccaggactgtttcccaaactaaaccatacaaattgcgacaagggcgccattcctctcatgtggaccggtatgatcgacctgccagggtattacgaggcaatacacccctgtactgtcttctgcgtgctttctggaccgggcgcttcatgtgaggccttcagtgaaggcgggatttttaacatcacaagccctatgtgcctggtctccaaacagaatcggttccgcttgaccgagcaacaggtgaactttgtttgtcaaagagtggatgtagacatcattgtctactgcaacggacagaggaaggtgatcctcacgaagaccctggttattggtcagtgtatatatacaatcacttctttattctcgctgctccccggcgtggcgcacagcattgccgtcgaactttgcgtgccagggtttcatggatgggcaaccgctgccctgttggtaacattctgttttggctgggtgctaatccctgctatcactttcattatactgaccatcctcaaatttattgccaatatcttccacacatccaaccaagagaatcggctgaagtcagttcttcgcaaaattaaggaagagtttgagaaaaccaagggtagtatggtctgcgatgtgtgtaagtacgaatgcgagacttataaagaactgaaggcacatggggtgtcttgcccccagagccagtgtccatactgcttcacgcactgtgagcccacagaagccgcttttcaggcgcattataaagtctgccaagttacccaccgattcagagacgatttgaagaaaactgtgacccctcagaacttcacaccaggctgttacaggaccctcaatctgtttcggtataagtcccgttgctacatcttcactatgtggatatttttactggtgctagagtcaatcctctgggcagccagcgcttctgagacaccgctgacgcccgtatggaacgacaatgcccacggagtcggctccgtgcctatgcataccgatcttgaattggacttcagtctgacttctagctccaagtacacatatcgcagaaaactcaccaacccactggaggaagcacagtcaattgatcttcacatcgagattgaggaacagacaatcggggttgacgtgcatgccctgggacactggtttgatggtaggttgaatctcaagactagcttccactgttacggcgcttgcaccaaatatgagtacccctggcatacggccaagtgtcactatgaacgggactaccaatatgagaccagctgggggtgcaacccttcggactgtccaggagtcggcacaggttgcactgcatgcgggctgtacttagatcgactgaaacccgtgggctccgcgtacaagataattaccatccgctattctagaagggtttgtgtgcagtttggagaagagaatctatgcaagattatcgacatgaacgattgtttcgtaagccggcatgtcaaagtgtgcataatcggcacagtgtcaaagtttagtcagggggacactctcctgttctttggaccgcttgagggtggcgggttgattttcaaacactggtgtacctccacgtgccagtttggagatcctggcgacatcatgtctccacgcgataagggtttcctgtgtcccgagttccctgggagctttagaaagaagtgcaatttcgctacaacccccatttgtgaatacgacggcaacatggtctccggatataaaaaggttatggccactatcgattcatttcagagcttcaatacaagtaccatgcattttactgacgaaaggatagagtggaaggatccagacggcatgctccgtgatcacattaacatcctggtgaccaaagacatcgacttcgataacttaggggaaaatccttgcaagattggactgcagacatcttccatcgagggcgcatggggtagcggggtaggatttacgcttacctgtttggtgtcgctcactgagtgccccacattcctgacctcaattaaagcctgcgacaaggctatatgttacggcgccgaatctgtcacactaactcggggtcagaacaccgtgaaagttagtggcaagggcggacactccggcagcacgtttaagtgctgtcatggggaggattgctctcagatcggactgcacgcagctgccccacatctcgacaaagtgaatggcattagcgaaatggagaactccaaggtctatgatgacggtgcgccgcaatgtgggatcaaatgctggttcgtgaagtcaggagaatggattagtggcatctttagcggtaattggatagttctgatcgtgctttgtgtcttcttgctgttctctttagtactcctgtccattctttgccctgtgcgaaaacacaagaagtcatga

SEQ ID NO: 10048 - RNA, 3408 nt, synthetic construct
  misc_feature 1..3408: note = derived and/or modified CDS sequence (opt3) from HTNV(Aa14-404)__KT935018.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagatggtgcctgaatcaagttgtagcatggacaaccatcaatccctgaatacgatcaccaagtacacacaggtttcttggaggggtaaagccgatcagtcgcagtcaagccaaaacagttttgagactgtgtccaccgaagtcgacctaaagggcacatgcgtgctcaaacacaagatggtagaggagtcttatcggagccgcaagtccattacctgttacgatctgtcatgcaatagtacttattgtaaaccaacactttacatgatcgttcccattcatgcgtgcaacatgatgaaaagctgtctgatcgctttggggccttatcgagtgcaggtcgtgtacgaacgtacctactgcatgacgggagtgctcatagagggcaagtgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagcacctgtaacgacacagagaataaggtgcaaggatactatatttgcatcgtcggcggcaactctgcccccatttacgtgcctactctggatgacttcagatccatggaggcttttaccgggatcttcaggagcccacacggagaagatcacgacctggctggtgaagagatcgccacatattcgattgtaggcccggctaatgccaaagttccccattctgcgtcctcagataccctcagtttaatagcatacagcgggatcccttcctattctagcctgtcaattcttacgagttccactgaagccaagcacgtgtttagcccaggattgttccccaaactgaaccatacaaattgcgacaagtctgctatccctctaatgtggaccggcatgatagacctcccaggttactacgaggccgtccacccctgtactgtgttttgcgtcctgtcagggccgggagcaagttgtgaggctttcagcgaaggcggcattttcaacatcacatcccctatgtgccttgtgtctaaacagaatcggtttcgcctgaccgagcagcaggttaacttcgtgtgtcaaagagtagatgtcgacatcgtggtttattgcaacgggcagaggaaggtgattttgacgaagaccctcgtcatcggacagtgtatttacacaataacttcgctgtttagcttactgcccggtgtggcccactccatcgcggtagaactctgcgtgccaggcttccatgggtgggccaccgcagcacttctggttacattttgtttcggatgggtcttgattcctgccatcacttttatcattctaaccatactgaaattcatcgctaatatttttcacacatcaaaccaagagaatcggctcaagagtgtgctgcgcaaaatcaaggaagagttcgagaaaaccaagggctctatggtgtgcgatgtctgtaagtatgaatgcgagacttacaaagaacttaaggcccatggtgttagctgcccccagtcccagtgtccatattgctttacgcactgtgagcccacagaagcaaccttccaggcccattacaaagtgtgccaagtgactcaccgatttagagacgatctgaagaaaaccgtaacacctcagaacttcaccccagggtgttataggactttgaatctcttccggtacaagtcacgttgctacatttttacaatgtggatcttcctgttagtcctggagagcatactatgggctgcgtctgcatccgagacgccgctcacccccgtgtggaacgacaatgcccacggcgttggaagtgtgcctatgcatactgatctggaacttgactttagcttgacatcttcctcaaagtatacctaccgcagaaaactgacaaacccactcgaggaagctcagagtatcgatctgcacattgagatcgaggaacagactattggcgtcgacgtgcatgcccttgggcactggttcgatggaaggctgaatttgaagaccagctttcactgttatggtgcatgcacgaaatacgagtatccctggcataccgccaagtgtcactacgaacgggactatcaatacgagacatcgtggggctgcaacccttccgactgtccaggggttggaactggctgcaccgcttgcggtctctacctggatcagttaaaacccgtggggtctgcctataagatcataacaattcgatacagccgcagagtatgtgtccagttcggcgaagagaatctgtgcaagatcattgacatgaacgattgttttgtgtcaaggcatgtgaaagtctgcatcataggaactgttagtaagttctcccagggcgacaccctactctttttcgggccgctggagggaggtggccttatctttaaacactggtgtacgtctacatgccaattcggggatcctggagacattatgagcccacgggataagggctttttgtgtcccgagttccctggttccttccgcaaaaagtgcaattttgcaaccactcccctgtgtgaatatgacgggaacatggtgtcaggctacaaaaaggtaatggcgacaatcgatagcttccagagttttaatacctctactatgcatttcaccgacgaaagaattgagtggaaggatccagacggaatgctcagggatcacatcaacatactggtgacaaaagacattgactttgataacttaggcgaaaatccttgcaagatcgggctgcagacgtccagcatcgagggagcttggggctcgggtgtcgggttcacccttacttgtttggtgtcactcacagagtgccccacctttctgacatctattaaagcctgcgacaaggcaatctgttatggagccgaaagtgttactctaacccgtggccagaacacggtgaaagtctccggtaagggcgggcacagcggatctacattcaagtgctgtcatggcgaggattgcagccaaattgggctgcacgctgccgcaccacatctcgacaaagtgaatggaatatccgaaatggagaactcaaaggtttacgatgacggcgctccgcagtgtggtatcaaatgctggtttgtgaagagtggggaatggattagcggaatcttctctggcaattggattgtcctgatcgtactttgtgtgtttttgctgttctccttagttctcctgtcaatactttgccctgtgcggaaacacaagaagagttga

SEQ ID NO: 10049 - RNA, 3408 nt, synthetic construct
  misc_feature 1..3408: note = derived and/or modified CDS sequence (opt3) from HTNV(Aa14-423)__KT935022.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagatggtgcctgaatcaagttgtagcatggacaaccatcaatccctgaatacgatcaccaagtacacacaggtttcttggaggggtaaagccgatcagtcgcagtcaagccaaaacagttttgagactgtgtccaccgaagtcgacctaaagggcacatgcgtgctcaaacacaagatggtagaggagtcttatcggagccgcaagtccattacctgttacgatctgtcatgcaatagtacttattgtaaaccaacactttacatgatcgttcccattcatgcgtgcaacatgatgaaaagctgtctgatcgctttggggccttatcgagtgcaggtcgtgtacgaacgtacctactgcatgacgggagtgctcatagagggcaagtgtttcgtcccagaccagtctgttgtgtccatcattaagcacggtatctttgatattgcctcagtacatatcgtgtgcttctttgtcgcagtgaaagggaatacttataagatattcgaacaggttaagaaaagttttgagagcacctgtaacgacacagagaataaggtgcaaggatactatatttgcatcgtcggcggcaactctgcccccatttacgtgcctactctggatgacttcagatccatggaggcttttaccgggatcttcaggagcccacacggagaagatcacgacctggctggtgaagagatcgccacatattcgattgtaggcccggctaatgccaaagttccccattctgcgtcctcagataccctcagtttaatagcatacagcgggatcccttcctattctagcctgtcaattcttacgagttccactgaagccaagcacgtgtttagcccaggattgttccccaaactgaaccatacaaattgcgacaagtctgctatccctctaatgtggaccggcatgatagacctcccaggttactacgaggccgtccacccctgtactgtgttttgcgtcctgtcagggccgggagcaagttgtgaggctttcagcgaaggcggcattttcaacatcacatcccctatgtgccttgtgtctaaacagaatcggtttcgcctgaccgagcagcaggttaacttcgtgtgtcaaagagtagatgtcgacatcgtggtttattgcaacgggcagaggaaggtgattttgacgaagaccctcgtcatcggacagtgtatttacacaataacttcgctgtttagcttactgcccggtgtggcccactccatcgcggtagaactctgcgtgccaggcttccatgggtgggccaccgcagcacttctggttacattttgtttcggatgggtcttgattcctgccatcactctaatcattctgaccatactcaaatttatcgctaatattttccacacatcaaaccaagagaatcggctgaagagtgtgcttcgcaaaatcaaggaagagtttgagaaaaccaagggctctatggtgtgcgatgtctgtaagtatgaatgcgagacttacaaagaactgaaggcccatggtgttagctgcccccagtcccagtgtccatattgcttcacgcactgtgagcccacagaagcaacctttcaggcccattacaaagtgtgccaagtgactcaccgattcagagacgatttgaagaaaaccgtaacacctcagaactttaccccagggtgttataggactctcaatctgttccggtacaagtcacgttgctacattttcacaatgtggatctttttactggtcctagagagcatactctgggctgcgtctgcatccgagacgccgctgacccccgtgtggaacgacaatgcccacggcgttggaagtgtgcctatgcatactgatcttgaattggacttcagcctgacatcttcctcaaagtatacctaccgcagaaaactcacaaacccactggaggaagctcagagtatcgatcttcacattgagatcgaggaacagactattggcgtcgacgtgcatgccctggggcactggtttgatggaaggttgaatctcaagaccagcttccactgttatggtgcatgcacgaaatacgagtatccctggcataccgccaagtgtcactacgaacgggactatcaatacgagacatcgtggggctgcaacccttccgactgtccaggggttggaactggctgcaccgcttgcggtctgtacttagatcagctgaaacccgtggggtctgcctataagatcataacaattcgatacagccgcagagtatgtgtccagtttggcgaagagaatctatgcaagatcattgacatgaacgattgtttcgtgtcaaggcatgtgaaagtctgcatcataggaactgttagtaagttttcccagggcgacaccctcctgttctttgggccgcttgagggaggtggcttgatcttcaaacactggtgtacgtctacatgccaatttggggatcctggagacattatgagcccacgggataagggcttcctgtgtcccgaatttcctggttccttccgcaaaaagtgcaatttcgcaaccactcccctctgtgagtatgacgggaacatggtgtcaggctacaaaaaggtaatggcgacaatcgatagctttcagagtttcaatacctctactatgcattttaccgacgaaagaattgagtggaaggatccagacggaatgctgagggatcacatcaacatattagtgacaaaagacattgacttcgataacctgggcgaaaatccttgcaagatcgggcttcagacgtccagcatcgagggagcttggggctcgggtgtcgggtttaccttgacttgtctcgtgtcactgacagagtgccccaccttcctaacatctattaaagcctgcgacaaggcaatctgttatggagccgaaagtgttactctgacccgtggccagaacacggtgaaagtctccggtaagggcgggcacagcggatctacatttaagtgctgtcatggcgaggattgcagccaaattgggctccacgctgccgcaccacatctggacaaagtgaatggaatatccgaaatggagaactcaaaggtttacgatgacggcgctccgcagtgtggtatcaaatgctggttcgtgaagagtggggaatggattagcggaatcttttctggcaattggattgtccttatcgtattgtgtgtgttcctgttattttccctcgttctgctttcaatactgtgccctgtgcggaaacacaagaagagttga

SEQ ID NO: 10050 - RNA, 3408 nt, synthetic construct
  misc_feature 1..3408: note = derived and/or modified CDS sequence (opt3) from HTNV(Aa15-56)__KU207187.1__GP
  source 1..3408: mol_type = other RNA
atgggcatctggaagtggctggtgatggccagcctcgtctggcccgttcttaccctgagaaacgtgtacgacatgaaaattgagtgccctcacacagtatccttcggggaaaattctgtgataggatatgtcgagttgccaccgatgcccttagctgatactgcacagctggtgcctgaatcaagttgtagcatggacaaccatcaatccctaaatacgatcaccaagtacacacaggtttcttggaggcggaaagccgatcagtcgcagtcaagccaaaacagttttgagactgtgtccaccgaagtcgacctcaagggtacatgcgtgctgaaacacaagatggtagaggagtcttatcgcagccgaaagtccattacctgttacgatctttcatgcaatagtacttattgtaaaccaacactgtacatgatcgttcccattcatgcgtgcaacatgatgaaaagctgtttgatcgctctcggcccttatcgtgtgcaggtcgtgtacgaaagaacctactgcatgacgggggccctgatagagggaaagtgtttcgtgccagaccagtctgtcgtttccatcattaagcacggcatctttgatattgcatcagtgcatatcgtatgcttctttgtggccgtcaaaggtaatacttataagatattcgaacaggtgaagaaaagttttgagagtacctgtaacgacacagagaataaggttcaagggtactatatttgcatcgtgggaggcaactctgctcccatttacgtccctactctggatgacttcaggtccatggaagcatttaccggcatcttccggagcccacacggggaggatcacgacctcgccggagaagagacagctacctattcgatcgtgggtccggccaatgcgaaagtaccccattctgcatcctcagatacgttaagtctgattgcctttagcggcataccttcctactctagcctttcaatcttgactagctccacagaagctaagcacgttttcagcccagggctgtttcccaaactaaaccataccaattgcgacaagggagccattcctctcatgtggactggcatgatcgacctgccaggttattacgaggcaatacacccctgtacagtgttctgcgtcctttctgggccgggagcttcatgtgaggccttcagtgaaggcggcatttttaacatcaccagccctatgtgcctggtgtccaaacagaatcgcttcagattgacggagcagcaggtcaactttgtgtgtcaaagggttgatgtggacatcgtagtctactgcaacgggcagcggaaggtgattctcaccaagacactggttatcggacagtgtatttatactataacctctttattctcgctgctccccggtgtggcgcacagcatcgccgtcgaactttgcgtgccaggctttcatgggtgggcaacagctgccctgttggtaactttctgttttggatgggtgctaattcctgctatcaccttcatcattctgacaatactcaaatttatcgccaatattttccacacctccaaccaagagaatcgcctgaagtcagttcttcgaaaaatcaaggaagagtttgagaaaactaagggcagtatggtctgcgatgtgtgtaagtacgaatgcgagacgtataaagaactgaaggcacatggtgtgtcttgcccccagagccagtgtccatactgcttcacacactgtgagcccaccgaagccgcttttcaggcgcattataaagtctgccaagttactcacagattcagggacgatttgaagaaaaccgtgacacctcagaacttcaccccagggtgttaccggactctcaatctgtttcgttataagtcccgctgctacattttcacaatgtggatctttttactggtgctagagtcaatactctgggcagccagcgcttctgagacgccgctgacccccgtatggaacgacaatgcccacggcgtcggatccgtgcctatgcatactgatcttgaattggacttcagtctgacaagcagctccaagtacacctatagaaggaaactcacaaacccactggaggaagcacagtcaatcgatcttcacattgagatcgaggaacagactattggcgttgacgtgcatgccctggggcactggtttgatggacggttgaatctcaagaccagtttccactgttacggtgcttgcacgaaatatgagtacccctggcataccgccaagtgtcactatgaacgagactaccaatatgagacaagctggggctgcaacccttcggactgtccaggggtcggaactggctgcaccgcatgcggtctgtacttagatcgcctgaaacccgtggggtccgcgtacaagatcataacaattagatattctaggcgggtttgtgtgcagtttggcgaagagaatctatgcaagatcattgacatgaacgattgtttcgtaagccgccatgtcaaagtgtgcatcataggaactgtgtcaaagtttagtcagggcgacaccctcctgttctttgggccgcttgagggaggtggcttgatcttcaaacactggtgtacgtccacatgccagtttggggatcctggagacattatgtctccaagagataagggcttcctgtgtcccgagttccctggtagctttaggaaaaagtgcaatttcgctaccactcccatctgtgaatacgacgggaacatggtctccggctataaaaaggttatggccacaattgattcatttcaatctttcaataccagtactatgcattttaccgacgaacgtatcgagtggaaggatccagacggaatgctccgggatcacataaacattctggtgacaaaagacatcgacttcgataacttaggcgaaaatccttgcaagatcgggctgcagacgtcttccattgagggagcatggggcagcggtgtagggtttacccttacttgtttggtgtcgctcacagagtgccccaccttcctgacatcaatcaaagcctgcgacaaggctatttgttacggagccgaatctgtcactctaacccgaggccagaacacggtgaaagttagtggtaagggcgggcactccggaagcacatttaagtgctgtcatggcgaggattgctctcagatagggctgcacgcagctgccccacatctcgacaaagtgaatggaatcagcgaaatggagaactccaaggtctatgatgacggcgcgccgcaatgtggtattaaatgctggttcgtgaagtcaggggaatggatcagtggaatttttagcggcaattggatcgttctgatagtgctttgtgtcttcttgctgttctctttagtactcctgtccatcctttgccctgtgagaaaacacaagaagtcatga

SEQ ID NO: 10051 - RNA, 3408 nt, synthetic construct
  misc_feature 1..3408: note = derived and/or modified CDS sequence (opt3) from HTNV(CBAa11-106)__KC576787.1__GP
  source 1..3408: mol_type = other RNA
atgggcatgtggaagtggctggtgatcgccagcctcgtctggcccgctcttaccctgagaaacgtttacgacatgaaaattgagtgccctcacacagtgtccttcggggaaaattctgtaataggatatgtggagttgccaccgatgcccttagcagatactgcccagatggtccctgaatcaagttgtagcatggacaaccatcaatccatgaatacgatcaccaagtacacacaggtgatttggaggggtaaagcggatccaggccagtcttcgcagaactcatttgagactgttagcaccgaaatcgacctgaaggggacatgcgtgctaaaacacaagatggtcgaggagagttatcggtcccgcaagtctattacctgttacgatctcagctgcaattccacttattgtaaacccacactgtacatgatcgtgcctatacatgcttgcaacatgatgaagtcatgtcttatcgccctgggaccatatcgagtacaagttgtgtacgaacgtacctactgcatgacgggcgtcttgattgagggtaaatgtttcgtgcccgaccagagtgtggtcagcatcattaagcacgggatctttgatatagcatctgttcatattgtgtgcttctttgtagccgtgaaaggaaatacttataaactcttcgaacaggtcaagaagtcctttgagtcaacctgtaacgacacagagaataaggtgcagggctactatatctgcattgttggcgggaacttcgctcctatctacgtgccaactctggatgactttagaagcatggaagcattcaccggaatctttaggagtccgcacggtgaggatcacgacctggccggcgaagagattgcttcttattccatagtcgggcccgccaatgcgaaagtgcctcatagcgcatcgtctgatacactctccttaatcgcctactcagggattccaagttatagctccctgtctatccttaccagctcaacggaagctaagcacgtattcagtcccggcttgtttcctaaactgaaccatactaattgcgacaagtccgccataccactaacatggaccggtatgattgacctccccgggtactacgaggcaatccacccgtgtactgttttctgcgtgctgagcggacctggcgcttcttgtgaggccttctcagaaggcgggatctttaacattacaagtcccatgtgccttgtcagcaaacaaaatcggttccgcctgaccgagcaacaggtgaactttgtctgtcagagagtggatatggacatcgttgtgtattgcaacggacagaggaaggtaattttgacgaagaccctcgtcataggtcagtgtatctacacaattacttccctgttctctttactgccaggcgtggcgcactcgatcgccgttgaactctgcgtgcctgggtttcatggatgggcaaccgctgcccttctggtcacattctgttttggctgggtgttgatccccgctattactttcataatcctaaccgtactgaaatttgtggccaatattttccacacaagcaaccaggagaatcggctcaagtccgttctgcgcaaaatcaaggaagagtttgagaaaaccaagggttcaatggtctgcgatgtgtgtaagtatgaatgcgagacttacaaagaacttaaggcacatggggtgagttgcccacaatctcagtgtccctattgcttcacgcactgtgagcctacagaagccgcttttcaggcgcattacaaagtctgccaggttacccaccgattcagagacgatctgaagaaaactgtgaccccacaaaacttcacaccgggctgttataggaccttgaatctctttcggtacaagagccgttgctacattttcactatgtgggtgtttctgttaatcctggagtccgtactatgggcagcctcagctagcgagacacccctcacgcctgtctggaacgacaatgcccacggagtgggctctgttccaatgcataccgatctggaacttgacttctccttgacttccagctctaagtatacataccgcagaaaactgaccaaccccctcgaggaagcacagtccatagatctgcacatcgagattgaggaacagacaatcggggtggacgtccatgcccttggacactggtttgatggtaggctgaatttgaagacttcattccactgttatggcgcttgcaccaaatacgagtatccttggcatacggccaagtgtcactacgaacgggactatcagtacgagaccagttgggggtgcaacccaagcgactgtcccggagtgggcacaggttgcactgcatgcgggctctacctggatcaattaaaaccggttggctcggcgtataagattatcaccatacgatactcccgcagagtgtgtgtacagtttggagaagagaatctgtgcaagattatcgacatgaacgattgtttcgtctctaggcatgtgaaagtgtgcattatcggcacagtcagcaagttttcacagggggacactctactcttctttggacctctggagggtggcgggcttatattcaaacactggtgtaccagtacgtgccagtttggagatccaggcgacatcatgagtccccgggataagggtttcttgtgtcctgagttccccgggtcttttcgcaaaaagtgcaatttcgctacaaccccaatttgtgaatatgacggcaacatggttagcggatacaaaaaggtgatggccactatcgattcctttcaatcattcaatacaagcaccatgcattttactgacgaaagaattgagtggaaggatcctgacggcatgctgagggatcacatcaacatactcgtaaccaaagacattgacttcgataacctgggggaaaatccctgcaagatcggattacagacaagttctatcgagggcgcatggggttccggggtgggatttacgctgacctgtcttgtcagcttgactgagtgcccaacattcctcacctcgattaaagcctgcgacaaggctatctgttatggcgccgaatcagtgacactgactcgtggtcagaacaccgttaaagtgtctggcaagggaggacacagtggctccacgtttaagtgctgtcatggggaggattgcagccagattggactacacgcagctgccccgcatctggacaaagtcaatggcatatctgaaatcgagaacagcaaggtgtacgatgacggtgcgcctcaatgtgggattaaatgctggttcgttaagtccggagaatggatctcaggcatttttagtggtaattggatcgtgctcatagtcctgtgtgtattccttttgttcagcctggtgttactctctatcctgtgccccgttcggaaacacaagaagtcctga

SEQ ID NO: 10052 - RNA, 3408 nt, synthetic construct
  misc_feature 1..3408: note = derived and/or modified CDS sequence (opt3) from HTNV(CBAa11-26)__KC576786.1__GP
  source 1..3408: mol_type = other RNA
atgggcatgtggaagtggctggtgatcgccagcctcgtctggcccgctcttaccctgagaaacgtttacgacatgaaaattgagtgccctcacacagtgtccttcggggaaaattctgtaataggatatgtggagttgccaccgatgcccttagcagatactgcccagatggtccctgaatcaagttgtagcatggacaaccatcaatccatgaatacgatcaccaagtacacacaggtgatttggaggggtaaagcggatccaggccagtcttcgcagaactcatttgagactgttagcaccgaaatcgacctgaaggggacatgcgtgctaaaacacaagatggtcgaggagagttatcggtcccgcaagtctattacctgttacgatctcagctgcaattccacttattgtaaacccacactgtacatgatcgtgcctatacatgcttgcaacatgatgaagtcatgtcttatcgccctgggaccatatcgagtacaagttgtgtacgaacgtacctactgcatgacgggcgtcttgattgagggtaaatgtttcgtgcccgaccagagtgtggtcagcatcattaagcacgggatctttgatatagcatctgttcatattgtgtgcttctttgtagccgtgaaaggaaatacttataagttgttcgaacaggtcaagaaatcctttgagtcaacctgtaacgacacagagaataaggtgcagggctactatatctgcattgttggcgggaacagcgctcctatctacgtgccaactctggatgacttcagaagtatggaagcatttaccggaatcttcaggtctccgcacggtgaggatcacgacctggccggcgaagagattgcttcctatagcatagtcgggcccgccaatgcgaaagtgcctcattcggcatcttccgatacactctcattaatcgcctacagtgggattccaagctattcctctctgagcatccttacctcaagtacggaagctaagcacgtattttcccccggcttgttccctaaactgaaccatactaattgcgacaagagcgccataccactaacatggaccggtatgattgacctccccgggtactacgaggcaatccacccgtgtactgttttctgcgtgctgtctggacctggcgcttcatgtgaggccttcagtgaaggcgggatcttcaacattacaagccccatgtgccttgtctccaaacaaaatcggtttcgcctgaccgagcaacaggtgaacttcgtctgtcagagagtggatatggacatcgttgtgtattgcaacggacaaaggaaggtaattttgacgaagaccctcgtcataggtcagtgtatctacacaattacttctctgttttcgttactgccaggcgtggcgcacagcatcgccgttgaactctgcgtgcctgggttccatggatgggcaaccgctgcccttctggtcacattttgtttcggctgggtgttgatccccgctattacttttataatcctaaccgtactgaaattcgtggccaatatttttcacacatccaaccaggagaatcggctcaagtcagttctgcgcaaaatcaaggaagagttcgagaaaaccaagggtagtatggtctgcgatgtgtgtaagtatgaatgcgagacttacaaagaacttaaggcacatggggtgtcttgcccacaaagccagtgtccctattgctttacgcactgtgagcctacagaagccgctttccaggcgcattacaaagtctgccaggttacccaccgatttagagacgatctgaagaaaactgtgaccccacaaaacttcacaccgggctgttataggaccttgaatctcttccggtacaagtcccgttgctacatttttactatgtgggtgttcctgttaatcctggagtcagtactatgggcagccagcgcttctgagacacccctcacgcctgtctggaacgacaatgcccacggagtgggctccgttccaatgcataccgatctggaacttgactttagtttgacttctagctccaagtatacataccgcagaaaactgaccaaccccctcgaggaagcacagtcaatagatctgcacatcgagattgaggaacagacaatcggggtggacgtccatgcccttggacactggttcgatggtaggctgaatttgaagaccagttttcactgttatggcgcttgcactaaatacgagtatccttggcatacggccaagtgtcactacgaacgggactatcagtacgagaccagctgggggtgcaacccatcggactgtcccggagtgggcacaggttgcactgcatgcgggctctacctggatcaattaaaaccggttggctccgcgtataagattatcaccatacgatactctcgcagagtgtgtgtacagttcggagaagagaatctgtgcaagattatcgacatgaacgattgttttgtcagcaggcatgtgaaagtgtgcattatcggcacagtctcaaagttcagtcagggggacactctactctttttcggacctctggagggtggcgggcttatatttaaacactggtgtacctccacgtgccagttcggagatccaggcgacatcatgtctccccgggataagggttttctctgtcctgaatttcccgggagcttccgcaaaaagtgcaattttgctacaaccccaatttgtgagtatgacggcaacatggtttccggatacaaaaaggtgatggccactatcgattcattccagagctttaatacaagtaccatgcatttcactgacgaaagaattgagtggaaggatcctgacggcatgctgagggatcacatcaacatactcgtaaccaaagacattgactttgataacctgggggaaaatccctgcaagatcggattacagacatcttccatcgagggcgcatggggtagcggggtgggattcacgctgacctgtcttgtctcgttgactgagtgcccaacatttctcacctcaattaaagcctgcgacaaggctatctgttatggcgccgaatctgtgacactgactcgtggtcagaacaccgttaaagtgagtggcaagggaggacactccggcagcacgttcaagtgctgtcatggggaggattgctctcagattggactacacgcagctgccccgcatctggacaaagtcaatggcataagcgaaatcgagaactccaaggtgtacgatgacggtgcgcctcaatgtgggattaaatgctggtttgttaagtcaggagaatggatcagtggcattttcagcggtaattggatcgtgctcatagtcctgtgtgtatttcttttgttctctctggtgttactctccatcctgtgccccgttcggaaacacaagaagtcatga

SEQ ID NO: 10053 - RNA, 3408 nt, synthetic construct
  misc_feature 1..3408: note = derived and/or modified CDS sequence (opt3) from HTNV(Fuyuan-Aa-145)__KJ857336.1__GP
  source 1..3408: mol_type = other RNA
atgggcatgtggaagtggctggtgatcgccagcctcgtctggcccgctctttccctgagaaacgtttacgacatgaaaattgagtgccctcacaccgtgtctttcggggaaaattcagtaataggatatgtggagttgccaccgatgcccttagcagatacagcccagatggtccctgaaagtagctgttccatggacaaccatcaatctatcaatactattacgaagtacacccaggtgatctggaggggtaaagcggatccaggccagtcgtcacagaacagctttgagacagttagtactgaagtggacctgaaggggacctgcgtcctaaaacacaagatggtggaggagtcctatcggtctcgcaagagcattacatgttacgatctctcctgcaattcaaccttctgtaaacccactctgtatatgatcgtacctatacatgcttgcaacatgatgaagagttgtcttatcgccctgggaccataccgagttcaagtggtctatgaacgtacatactgcatgaccggcgtgttgattgagggtaaatgttttgtgcccgaccagagcgtcgtttctatcattaagcacgggatcttcgatatagcatccgtgcatgtagtgtgctttttcgtcgccgtgaaaggaaatacgtacaagctctttgaacaggttaagaaatcattcgagagcacttgtaacgacaccgagaataaggtgcagggctattacatttgcatcgtcggcgggaacagtgctcctatttatgtgccaacactggatgactttagatctatggaagcattcactggaatctttaaatccccgcacggtgaggatcacgacctggccggcgaagagatcgctagctactcgattgtagggcccgccaatgcgaaggttcctcattctgcatcctcagataccctcagtttaatagcctatagcggaatcccatcctactctagcctgtcaattcttacaagttccaccgacgctaaacacgtgttcagccccggcttgtttcctaagctgaaccatacgaattgcgacaaatctgccatcccactaacttggacaggtatgatagatctccccgggtattacgaagcaattcacccgtgtaccgtcttctgcgtgctgtcaggacctggcgctagttgtgaggccttcagcgagggcgggatctttaacatcacttcccccatgtgccttgtctctaagcaaaataggttccggctgacagaacaacaggtgaactttgtttgtcagcgcgtggacatggatattgtagtctactgcaacggacagagaaaggtgatcttgaccaaaacgctcgttattggtcagtgtatatataccatcacatcgctgttcagcttactgccaggcgtggcgcactccattgccgtcgagctctgcgtgcctgggtttcatggatgggcaactgctgcccttctggtaaccttctgttttggctgggtgttgatccccgctgttacattcatcattctaactgtcctgaagtttatagccaatatcttccacacctcaaaccaggaaaataggctcaaaagtgtgctgcggaagattaaagaggaatttgagaagacaaagggttctatggtgtgcgacgtctgtaaatacgagtgcgaaacctataaggagcttaaagcacatggggttagctgcccacaatcccagtgtccctactgcttcactcactgtgaacctacggaggccgcttttcaggcgcattataaggtgtgccaggtgacacaccgcttccgagatgacctgaaaaagaccgtaactccacaaaacttcaccccgggctgttacagaacattgaatctctttaggtataagtcacggtgctacatcttcaccatgtgggtctttctgttaattctggaaagcgtgctatgggcagcctctgcttccgagactcccctcacacctgtttggaacgataatgcccacggagtgggcagtgtcccaatgcatacggacctggagcttgatttcagcttgacctcttcctcaaaatacacttatcgtcgcaagctgacaaaccccctcgaagaggcacagagtatcgacctgcacatagaaatcgaggagcagaccattggggtggatgttcatgcccttggacactggtttgacggtagactgaatttgaaaactagcttccactgttacggcgcttgcacaaagtatgaatacccttggcataccgccaaatgtcactatgagagggactaccagtatgaaacgtcgtgggggtgcaacccatccgattgtcccggagtgggcaccggttgcacagcatgcgggctctacctggaccaattaaagccggtaggctctgcgtacaagatcattactatccggtatagccgacgcgtctgtgtgcagtttggagaggaaaatctgtgcaaaataattgatatgaacgactgtttcgtgtcaagacatgtcaaggtttgcatcattggcaccgtgagtaaattttcccagggggatacactactcttctttggacctctggagggtggcgggcttatcttcaagcactggtgtacttctacctgccagtttggagacccaggcgatataatgagccccagggacaaaggtttcttgtgtcctgagttccccgggtcctttcggaagaaatgcaatttcgctacgacaccaatctgtgaatacgatggcaacatggtatcaggatataagaaggtgatggccaccattgacagctttcaaagtttcaatacttctacaatgcattttaccgatgagcgcatcgaatggaaagaccctgatggcatgctgagagaccacattaacatcctcgtcactaaggacatagatttcgacaacctgggggagaatccctgcaaaattggattacagacctccagcatcgaaggcgcatggggttcgggggtgggatttacactgacgtgtcttgtttcattgaccgagtgcccaactttcctcacatctatcaaggcctgcgataaagctatttgttacggcgccgagagtgtgaccctgacaaggggtcagaacactgtcaaggtgtccggcaaagggggacacagcggctctacctttaagtgctgtcatggggaagactgcagcaagatcggactacacgcagctgccccgcatctggataaagttaatggcatttccgagatagaaaactcaaaggtgtatgacgatggtgcgcctcagtgtgggatcaaatgctggttcgtcaagagtggagagtggattagcggcatcttttctggtaattggattgtactcatcgtgctgtgtgttttccttttgttctccctggtgttactctcaatactgtgccccgtccgtaagcacaaaaagagttga

SEQ ID NO: 10054 - RNA, 3408 nt, synthetic construct
  misc_feature 1..3408: note = derived and/or modified CDS sequence (opt3) from HTNV(Fuyuan-Aa-26)__KJ857334.1__GP
  source 1..3408: mol_type = other RNA
atgggcatgtggaagtggctggtgatcgccagcctcgtctggcccgctctttccctgagaaacgtttacgacatgaaaattgagtgccctcacaccgtgtctttcggggaaaattcagtaataggatatgtggagttgccaccgatgcccttagcagatacagcccagatggtccctgaaagtagctgttccatggacaaccatcaatctatcaatactattacgaagtacacccaggtgatctggaggggtaaagcggatccaggccagtcgtcacagaacagctttgagacagttagtactgaagtggacctgaaggggacctgcgtcctaaaacacaagatggtggaggagtcctatcggtctcgcaagagcattacatgttacgatctctcctgcaattcaacctattgtaaacccactctgtacatgatcgtacctatacatgcttgcaacatgatgaagagttgtcttatcgccctgggaccatatcgagttcaagtggtctacgaacgtacatactgcatgaccggcgtgttgattgagggtaaatgtttcgtgcccgaccagagcgtcgtttctatcattaagcacgggatctttgatatagcatccgtgcatattgtatgcttctttgtggccgtcaaaggaaatacgtataaactcttcgaacaggtgaagaagtcatttgagagcacttgtaacgacaccgagaataaggttcagggctactatatctgcattgtgggcgggaacagtgctcctatctacgtcccaacactggatgacttcagatctatggaagcatttactggaatcttcaaatccccgcacggtgaggatcacgacctggccggcgaagagattgctagctattcgatagtggggcccgccaatgcgaaggtacctcattctgcatcctcagataccctcagtttaatcgcctacagcgggattccatcctattctagcctgtcaatccttacaagttccaccgacgctaaacacgtttttagccccggcttgttccctaagctgaaccatacgaattgcgacaaatctgccataccactaacttggacaggtatgattgatctccccgggtactacgaagcaatccacccgtgtaccgtgttttgcgtcctgtcaggacctggcgctagttgtgaggccttcagcgagggcgggatcttcaacattacttcccccatgtgccttgtgtctaagcaaaataggtttcggctgacagaacagcaggtcaacttcgtgtgtcagcgcgttgacatggatatcgtggtatattgcaacggacaaagaaaggtcattttgaccaaaacgctcgtgataggtcagtgtatctacaccattacatcgctgtttagcttactgccaggcgttgcgcactccatcgccgtggagctctgcgtccctgggttccatggatgggcaactgctgcccttctggtgaccttttgtttcggctgggtattgatccccgctgtgacatttattatactaactgttctgaagttcatcgccaatatttttcacacctcaaaccaggaaaataggctcaaaagtgtcctgcggaagatcaaagaggaatttgagaagacaaagggttctatggtgtgcgacgtgtgtaaatatgagtgcgaaacctacaaggagcttaaagcacatggggtcagctgcccacaatcccagtgtccctattgctttactcactgtgaacctacggaggccgctttccaggcgcattacaaggtttgccaggtgacacaccgctttcgagatgacctgaaaaagaccgtgactccacaaaacttcaccccgggctgttatagaacattgaatctcttcaggtacaagtcacggtgctacatttttaccatgtgggtattcctgttaatcctggaaagcgtcctatgggcagcctctgcttccgagactcccctcacacctgtgtggaacgataatgcccacggagttggcagtgtgccaatgcatacggacctggagcttgattttagcttgacctcttcctcaaaatatacttaccgtcgcaagctgacaaaccccctcgaagaggcacagagtatagacctgcacatcgaaattgaggagcagaccatcggggtcgatgtgcatgcccttggacactggttcgacggtagactgaatttgaaaactagctttcactgttatggcgcttgcacaaagtacgaatatccttggcataccgccaaatgtcactacgagagggactatcagtacgaaacgtcgtgggggtgcaacccatccgattgtcccggagttggcaccggttgcacagcatgcgggctctacctggaccaattaaagccggtgggctctgcgtataagattatcactatacggtacagccgacgcgtatgtgtccagttcggagaggaaaatctgtgcaaaattatcgatatgaacgactgttttgtgtcaagacatgtgaaggtctgcattatcggcaccgttagtaaattctcccagggggatacactactctttttcggacctctggagggtggcgggcttatatttaagcactggtgtacttctacctgccagttcggagacccaggcgatatcatgagccccagggacaaaggtttcttgtgtcctgagttccccgggtccttccggaagaaatgcaattttgctacgacaccaatttgtgaatatgatggcaacatggtgtcaggatacaagaaggtaatggccaccatcgacagcttccaaagttttaatacttctacaatgcatttcaccgatgagcgcattgaatggaaagaccctgatggcatgctgagagaccacatcaacatactcgtgactaaggacattgattttgacaacctgggggagaatccctgcaaaatcggattacagacctccagcatcgaaggcgcatggggttcgggggtcggattcacactgacgtgtcttgtgtcattgaccgagtgcccaacttttctcacatctattaaggcctgcgataaagctatctgttatggcgccgagagtgttaccctgacaaggggtcagaacactgtgaaggtctccggcaagggaggacacagcggctctaccttcaaatgctgtcatggggaagactgcagcaagattggactacacgcagctgccccgcatctggataaagtgaatggcatatccgagatcgaaaactcaaaggtttacgacgatggtgcgcctcagtgtgggattaaatgctggtttgtgaagagtggagagtggatcagcggcattttctctggtaattggatcgtcctcatagtactgtgtgtgtttcttttgttctccctggttttactctcaatcctgtgccccgtgcgtaagcacaaaaagagttga
